(12) United States Patent
Nadler et al.

(10) Patent No.: US 8,895,010 B2
(45) Date of Patent: Nov. 25, 2014

(54) ANTIBODY POLYPEPTIDES THAT ANTAGONIZE CD40L

(71) Applicants: Bristol-Myers Squibb Company, Princeton, NJ (US); Domantis Limited, Brentford, Middlesex (GB)

(72) Inventors: Steven G. Nadler, Princeton, NJ (US); James K. Tamura, Yardley, PA (US); Laura Price, Langhorne, PA (US); Robert P. Rehfuss, North Wales, PA (US); Suzanne J. Suchard, Wilmington, DE (US); Anish Suri, Yardley, PA (US); James William Bryson, Langhorne, PA (US); Aaron Yamniuk, Lawrenceville, NJ (US); Steven Grant, Swaffham Prior (GB); Olga Ignatovich, Cambridge (GB); Philip Drew, Histon (GB)

(73) Assignees: Bristol-Myers Squibb Company, Princeton, NJ (US); Domantis Limited, Brentford, Middlesex (GB)

( * ) Notice: Subject to any disclaimer, the term of this patent is extended or adjusted under 35 U.S.C. 154(b) by 0 days.

(21) Appl. No.: 13/650,493

(22) Filed: Oct. 12, 2012

(65) Prior Publication Data

US 2013/0095109 A1    Apr. 18, 2013

Related U.S. Application Data

(60) Provisional application No. 61/546,800, filed on Oct. 13, 2011, provisional application No. 61/655,110, filed on Jun. 4, 2012.

(51) Int. Cl.
| | | |
|---|---|---|
| *A61K 39/395* | (2006.01) | |
| *C07K 16/28* | (2006.01) | |
| *C07K 16/46* | (2006.01) | |
| *A61K 45/06* | (2006.01) | |
| *A61K 39/00* | (2006.01) | |
| *A61K 38/00* | (2006.01) | |

(52) U.S. Cl.
CPC ....... *C07K 16/2878* (2013.01); *C07K 2317/569* (2013.01); *C07K 2317/52* (2013.01); *C07K 2317/565* (2013.01); *C07K 16/283* (2013.01); *A61K 2039/545* (2013.01); *C07K 16/2875* (2013.01); *C07K 16/46* (2013.01); *C07K 2319/00* (2013.01); *C07K 2317/92* (2013.01); *A61K 2039/505* (2013.01); *C07K 2319/30* (2013.01); *C07K 16/468* (2013.01); *C07K 2317/76* (2013.01); *A61K 38/00* (2013.01); *A61K 39/3955* (2013.01); *A61K 45/06* (2013.01); *C07K 2317/21* (2013.01)
USPC .................. 424/154.1; 424/130.1; 424/133.1; 424/134.1; 424/141.1; 424/142.1; 424/143.1; 424/144.1; 424/152.1; 424/153.1; 424/173.1; 530/387.1; 530/387.3; 530/388.1; 530/388.15; 530/388.2; 530/388.22; 530/388.7; 530/388.73; 530/388.75

(58) Field of Classification Search
None
See application file for complete search history.

(56) References Cited

U.S. PATENT DOCUMENTS

| 7,094,874 B2 | 8/2006 | Peach et al. |
|---|---|---|
| 7,482,327 B2 | 1/2009 | Hagerty et al. |
| 2010/0166774 A1 | 7/2010 | Dali et al. |

FOREIGN PATENT DOCUMENTS

| WO | WO-2005003175 A2 | 1/2005 |
|---|---|---|
| WO | WO-2005035572 A2 | 4/2005 |
| WO | WO-2006030220 A1 | 3/2006 |
| WO | WO-2010023482 A2 | 3/2010 |
| WO | WO-2012115241 A1 | 8/2012 |
| WO | WO-2013118858 A1 | 8/2013 |

OTHER PUBLICATIONS

Adams, et al., "Development of a Chimeric Anti-CD40 Monoclonal Antibody That Synergizes with LEA29Y to Prolong Islet Allograft Survival" (2005) J. Immunol. 174: 542-550.

Daoussis, et al., "Increased expression of CD154 (CD40L) on stimulated T-cells from patients with psoriatic arthritis", *Rheumatology* (2007) 46: 227-231.

Chapman, et al., "PEGylated antibodies and antibody fragments for improved therapy: a review," *Adv. Drug Deliv. Rev.* (2002) 54(4):531-545.

de Kruif, et al., "Rapid selection of cell subpopulation-specific human monoclonal antibodies from a synthetic phage antibody library", *Proc. Natl. Acad. Sci. USA* (1995) 92: 3938-3942.

Duffau, et al., "Platelet CD154 Potentiates Interferon-α Secretion by Plasmacytoid Dendritic Cells in Systemic Lupus Erythematosus", *Sci. Transl. Med.* (2010) 2: 47: 1-10 (2010).

Durie, et al., "Antibody to the Ligand of CD40, GP39, Blocks the Occurrence of the Acute and Chronic Forms of Graft-vs-Host Disease", *J. Clin. Invest.* (1994) 94: 1333-1338.

Ferroni, et al., "Contribution of Platelet-Derived CD40 Ligand to Inflammation, Thrombosis and Neoangiogenesis". *Curr. Med. Chem.* (2007) 14: 2170-2180.

Garcia, et al., "Monocytic suppressive cells mediate cardiovascular transplantation tolerance in mice", *J. Clin. Inv.* (2010) 120: 2486-2496.

(Continued)

*Primary Examiner* — Phillip Gambel
(74) *Attorney, Agent, or Firm* — Drinker Biddle & Reath LLP

(57) ABSTRACT

Antibody polypeptides that specifically bind human CD40L are provided. The antibody polypeptides do not activate platelets. The antibody polypeptides are useful in the treatment of diseases involving CD40L activation, such as graft-related diseases and autoimmune diseases. The antibody polypeptides may be domain antibodies (dAbs) comprising a single $V_H$ or $V_K$ domain. The half-life of the antibody polypeptides may be increased by modifying the antibody polypeptides to be dual specific reagents that can also bind human serum albumin (HSA) or another antigen.

36 Claims, 29 Drawing Sheets

(20 of 29 Drawing Sheet(s) Filed in Color)

(56) References Cited

OTHER PUBLICATIONS

Gilson, et al., "Anti-CD40 Monoclonal Antibody Synergizes with CTLA4-Ig in Promoting Long-Term Graft Survival in Murine Models of Transplantation", *J. Immunol.* (2009) 183: 1625-1635.
Harrison, et al., "Screening of Phage Antibody Libraries", *Meth. Enzymol.* (1996) 267: 83-109.
Hoogenboom, et al., "Multi-subunit proteins on the surface of filamentous phage: methodologies for displaying antibody (Fab) heavy and light chains", *Nucleic Acids Res.* (1991) 19:4133-4137.
Huang, et al., "The Effect of Anti-CD40 Ligand Antibody on B Cells in Human Systemic Lupus Erythematosus", *Arthritis & Reumatism* (2002) 46: 1554-1562.
Im, et al., "Blockade of CD40 Ligand Suppresses Chronic Experimental Myasthenia Gravis by Down-Regulation of Th1 Differentiation and Up-Regulation of CTLA-4", *J. Immunol.* (2001) 166: 6893-6898.
Kanmaz, et al., "Monotherapy with the Novel Human Anti-CD-154 Monoclonal Antibody ABI793 in Rhesus Monkey Renal Transplantation Model", *Transplantation* (2004) 77: 914-920.
Koyama, et al., "Thrombophilia Associated With Anti-CD154 Monoclonal Antibody Treatment and Its Prophylaxis in Nonhuman Primates", Transplantation (2004) 77: 460-461.
Kuwana, et al., "T and B Cell Collaboration Is Essential for the Autoantibody Response to DNA Topoisomerase I in Systemic Sclerosis", *J. Immunol.* (1995) 155: 2703-2714.
Larsen, et al., "Rational Development of LEA29Y (belatacept), a High-Affinity Variant of CTLA4-Ig with Potent Immunosuppressive Properties", *Amer. J. Transplant.* (2005) 5: 443-453.
Lederer, et al., "Reduced CD40L Expression on ex vivo Activated CD4+ T-Lymphocytes from Patients with Execellent Renal Allograft Function Measured with a Rapid Whole Blood Flow Cytometry Procedure", *Int. Arch. Allergy Immunol.* (2004) 133: 276-284.
Marks, et al., "Human Antibody Fragments Specific for Human Blood Group Antigens from a Phage Display Library", *BioTechnology* (1993) 11: 1145-1149.
Oosterwegel, et al., "CTLA-4 and T cell activation", *Curr. Opin. Immunol.* (1999) 11: 294-300.
Reilly, et al., "Genetic Diversity in Human Fc Receptor II for Immunoglobulin G: Fcγ Receptor IIA Ligand-Binding Polymorphism", *Clin. Diagn. Lab. Immunol.* (1994) 1: 640-644.
Shi, et al., "Differential requirements for CD28 and CD40 ligand in the induction of experimental autoimmune myasthenia gravis", *Eur J. Immunol.* (1998) 28: 3587-3593.
Tomiyama, et al., "Response of Human Platelets to Activating Monoclonal Antibodies: Importance of FcγRII (CD32) Phenotype and Level of Expression", *Blood* (1992) 80: 2261-2268.
Daley et al., "Fc-Disabled Anti-Mouse CD40L Antibodies Retain Efficacy in Promoting Transplantation Tolerance," American Journal of Transplantation, Nov. 1, 2008, vol. 8, No. 11, pp. 2265-2271.
Yan Ge, et al., "Functional expression of chimeric Fab of an anti-CD40L mAb: Vector design an culture condition optimization", Biomedicine & Pharmacotherapy, Sep. 17, 2010, vol. 55, No. 1, pp. 52-59.
Holt, et al., "Domain antibodies: proteins for therapy", Trends in Biotechnology, Nov. 1, 2003, vol. 21, No. 11, pp. 484-490.
Suri, et al., Investigative Studies Demonstrate Reduced Risk for Thromboembolism (TE) by BMS-986004, an Anti-CD40L Domain antibody, Session 71: Novel Approaches to Treatment & Monitoring of Allograft Injury, Jun. 6, 2012, Publication Page No. 518, XP002690660, Abstract.
Internationai Search Report dated Mar. 12, 2013, issued in PCT Application No. PCT/US2012/059977 filed Oct. 12, 2012.
Aruffo, et al., "The CD40 Ligand, gp39, Is Defective in Activated T Cells from Patients with X-Linked Hyper-Igm Syndorme," *Cell* (1993) 72:291-300.
Ashokkumar, et al., "Allospecific CD154+ T Cells Associate with Rejection Risk After Pediatric Liver Transplantation," *Amer. J. Transplantation* (2009) 9: 179-191.

Ashokkumar, et al., Allospecific CD154+ T cells identify rejection-prone recipients after pediatric small-bowel transplantation, *Surgery* (2009) 146: 166-173.
Bartlett, et al., "Analysis of Intragraft Gene and Protein Expression of Costimulatory Molecules, CD80, CD86 and CD154, and Orthotopic Liver Transplant Recipients," *Amer. J. Transplantation* (2003) 3: 1363-1368.
Baumgart, et al., "Exaggerated inflammatory response of primary human myeloid dendritic cells to lipopolysaccharide in patients with inflammatory bowel disease," *Clinical and Experimental Immunology* (2009) 157: 423-436.
Biaconne, et al., "Expression of inducible lymphocyte costimulatory molecules in human renal allograft," *Nephrol. Diall. Transplant.* (1998) 13: 716-722.
Boumpas, et al., "A Short Course of BG9588 (Anti-CD40 Ligand Antibody) Improves Serologic Activity and Decreases Hematuria in Patients With Proliferative Lupus Glomerulonephritis," *Arthritis & Rheumatism* (2003), 48: 719-727.
Danese, et al., "Activated platelets are the source of elevated levels of soluble CD40 ligand and the circulation of inflammatory bowel disease patients," *Gut* (2003) 52: 1435-1441.
Grammer, et al., Abnormal germinal center reactions in systemic lupus erythematosus demonstrated by blockade of CD154-CD40 interactions *J. Clin. Invest.* (2003) 112: 1506-1520.
Kasran, et al., "Safety and tolerability of antagonist anti-human CD40 Mab ch5D12 in patients with moderate to severe Crohn's disease," *Aliment. Pharmacol. Ther.* (2005) 22: 111-122.
Kawai, et al., "CD154 Blockade for Induction of Mixed Chimerism and Prolonged Renal Allograft Survival in Nonhuman Primates," *Amer. J. Transplantation* (2004) 4: 1391-1398 (2004).
Kenyon, et al., "Long-term survival and fuction of intrahepatic islet allografts in rhesus monkeys treated with humanized anti-CD154," *Proc. Natl. Acad. Sci. USA* (1999) 96: 8132-8137.
Kimura, et al., "Study of Plasma Levels of Soluble CD40 Ligand in Systemic Lupus Erythematosus Patients Who Have Undergone Plasmapheresis," *Therapeutic Apheriss and Dialysis* (2005) 9: 64-68.
Kirk, et al., "CTLA4-Ig and anti-CD40 ligand prevent renal allograft rejection in primates," *Proc. Natl. Acad. Sci. USA.* (1997) 94: 8789-8794.
Komura, et al., "Elevated Circulating CD40 Concentrations in Patients with Systemic Sclerosis," *J. Reumatol.* (2004) 31: 514-519.
Ludwiczek, et al., "Plasma levels of soluble CD40 ligand are elevated in inflammatory bowel diseases," *Int. J. Colorectal Dis.* (2003) 18: 142-147.
Mach, et al., "Reduction of Atherosclerosis in mice by inhibition of CD40 signalling," *Nature* (1998) 394: 200-203.
Menchén, et al., "Matrix metalloproteinase 9 in involved in Crohn's disease associated platelet hyperactivation through th release of soluble CD40 ligand," *Gut* 58: (2009) 920-928.
Mirabet, et al., Platelet pro-aggregatory effects of CD40 monoclonal antibody. *Mol. Immunol.* (2008) 45: 937-44.
Montgomery, et al., "Combination Induction Thereapy With Monoclonal Antibodies Specidic for CE80, CD86, and CD154 in Nonhuman Primate Renal Transplantation," *Transplantation* (2002) 74: 1365-1369.
Orozco, et al., "Association of CD40 with rheumatoid arthritis confirmed in a large UK case-control study," *Ann. Rheum. Dis.* (2010) 69: 813-816.
Patel, et al., "The effect of anti-CD40 ligand in immune thrombocytopenic purpura," *British J. Haematology* (2008) 141: 545-548.
Prahalad, et al., "Elevated serum levels of soluble CF154 in children with juvenile idiopathic arthritis." *Pediatric Rheumatology* (2008) 6: 1-8.
Preston, et al., "IDEC-131 (Anti-CD154), Sirolimus and Donor Specific Transfusion Facilitate Operational Tolerance in Non-Human Primates," *Amer. J. Transplantation* (2005) 5: 1032-1041.
Raychaudhuri, et al., "Common variants at *CD40* and other loci confer risk of rheumatoid arthritis", *Nature Genetics* (2008) 40: 1216-1223.
Robles-Carrillo, et al., "Anti-CD4OL Immune Complexes Potently Activate Platelets In Vitro and Cause Thrombosis in FCGRA2A Transgenic Mice," *The Journal of Immunology* (2010) 185: 1577-1583.

(56) References Cited

OTHER PUBLICATIONS

Schönbeck, et al., "Inhibition of CD40 signaling limits evolution of established atherosclerosis in mice," *Proc. Natl. Acad. Sci.* (2000) 97: 7458-7463.

Schuler, et al., "Efficacy and Safety of AB1793, A Novel Human Anti-Human CD154 Monoclonal Antibody, in Cynomolgus Monkey Renal Allotransplantation," *Transplantation* (2004) 77: 717-726.

Vakkalanka, et al., "Elevated Levels and Functional Capacity of Soluble CD40 Ligand in Systemi Lupus Erythematosus Sera,", *Arthritis & Rheumatism* (1999) 42: 871-881.

Xu, et al., "Effects of Dose and Duration of Anti-CD154 Antibody Therapy in Preventing Renal Allograft Rejection in a Nonhuman Primate Model," *Transplantation Proceesdings* (2001) 33: 223-224.

International Preliminary Report on Patentability and Written Opinion of the international Search Authority mailed Apr. 24, 2014 in PCT Application No. PCT/US2012/059977.

Domain antibody-[AS]-THTCPPCP...

CT-long

Domain antibody-[AST]-EPKSSDKTHTSPPSP ...

CT-short

Domain antibody-[AS]-THTSPPSP...

N297Qlong Fc

Domain antibody-[AST]-EPKSSDKTHTSPPSP...

N297Qshort Fc

Domain antibody-[AS]-THTSPPSP...

Osteonectin signal peptide sequence:

MRAWIFFLLCLAGRALA ^ EVQLLES...(start of Domain antibody)

FIG. 4

BMS2h-572-633-CT-L2

MRAWIFFLLCLAGRALA^EVQLLESGGGLVQPGGSLRLSCAASGFTFNWELMGWARQAPGKGLE
WVSGIEGPGDVTYYADSVKGRFTISRDNSKNTLYLQMNSLRAEDTAVYYCVKVGKDAKSDYRGQ
GTLVTVSSASTEPKSSDKTHTSPPSPAPELLGGSSVFLFPPKPKDTLMISRTPEVTCVVVDVSH
EDPEVKFNWYVDGVEVHNAKTKPREEQYNSTYRVVSVLTVLHQDWLNGKEYKCKVSNKALPAPI
EKTISKAKGQPREPQVYTLPPSRDELTKNQVSLTCLVKGFYPSDIAVEWESNGQPENNYKTTPP
VLDSDGSFFLYSKLTVDKSRWQQGNVFSCSVMHEALHNHYTQKSLSLSPGK

BMS2h-572-633-CT-S1

MRAWIFFLLCLAGRALA^EVQLLESGGGLVQPGGSLRLSCAASGFTFNWELMGWARQAPGKGLE
WVSGIEGPGDVTYYADSVKGRFTISRDNSKNTLYLQMNSLRAEDTAVYYCVKVGKDAKSDYRGQ
GTLVTVSSASTHTSPPSPAPELLGGSSVFLFPPKPKDTLMISRTPEVTCVVVDVSHEDPEVKFN
WYVDGVEVHNAKTKPREEQYNSTYRVVSVLTVLHQDWLNGKEYKCKVSNKALPAPIEKTISKAK
GQPREPQVYTLPPSRDELTKNQVSLTCLVKGFYPSDIAVEWESNGQPENNYKTTPPVLDSDGSF
FLYSKLTVDKSRWQQGNVFSCSVMHEALHNHYTQKSLSLSPGK

BMS2h-572-633-N297Q long Fc

MRAWIFFLLCLAGRALA^EVQLLESGGGLVQPGGSLRLSCAASGFTFNWELMGWARQAPGKGLE
WVSGIEGPGDVTYYADSVKGRFTISRDNSKNTLYLQMNSLRAEDTAVYYCVKVGKDAKSDYRGQ
GTLVTVSSASTEPKSSDKTHTCPPCPAPELLGGPSVFLFPPKPKDTLMISRTPEVTCVVVDVSH
EDPEVKFNWYVDGVEVHNAKTKPREEQYQSTYRVVSVLTVLHQDWLNGKEYKCKVSNKALPAPI
EKTISKAKGQPREPQVYTLPPSRDELTKNQVSLTCLVKGFYPSDIAVEWESNGQPENNYKTTPP
VLDSDGSFFLYSKLTVDKSRWQQGNVFSCSVMHEALHNHYTQKSLSLSPGK

BMS2h-572-633-N297Q short Fc

MRAWIFFLLCLAGRALA^EVQLLESGGGLVQPGGSLRLSCAASGFTFNWELMGWARQAPGKGLE
WVSGIEGPGDVTYYADSVKGRFTISRDNSKNTLYLQMNSLRAEDTAVYYCVKVGKDAKSDYRGQ
GTLVTVSSASTHTCPPCPAPELLGGPSVFLFPPKPKDTLMISRTPEVTCVVVDVSHEDPEVKFN
WYVDGVEVHNAKTKPREEQYQSTYRVVSVLTVLHQDWLNGKEYKCKVSNKALPAPIEKTISKAK
GQPREPQVYTLPPSRDELTKNQVSLTCLVKGFYPSDIAVEWESNGQPENNYKTTPPVLDSDGSF
FLYSKLTVDKSRWQQGNVFSCSVMHEALHNHYTQKSLSLSPGK

FIG. 14
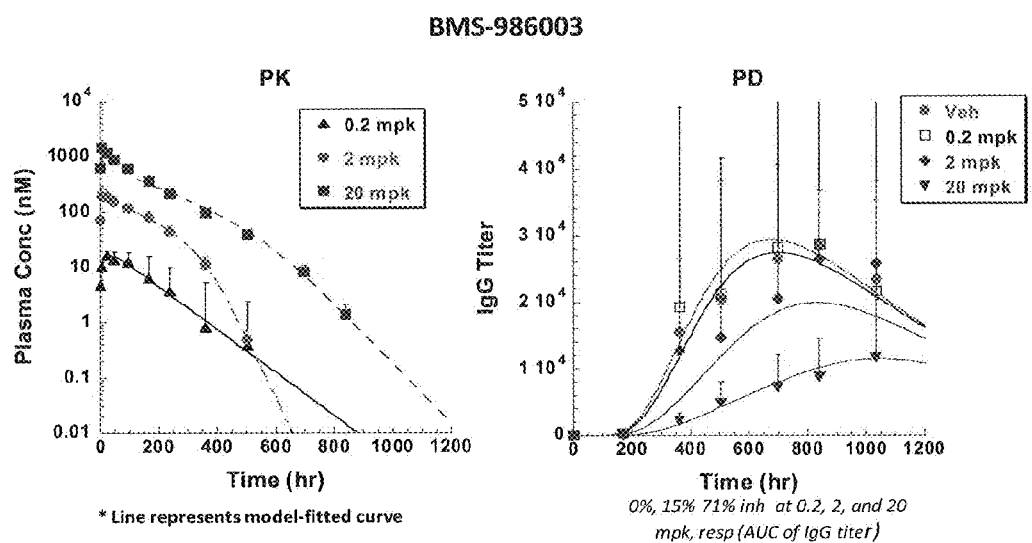
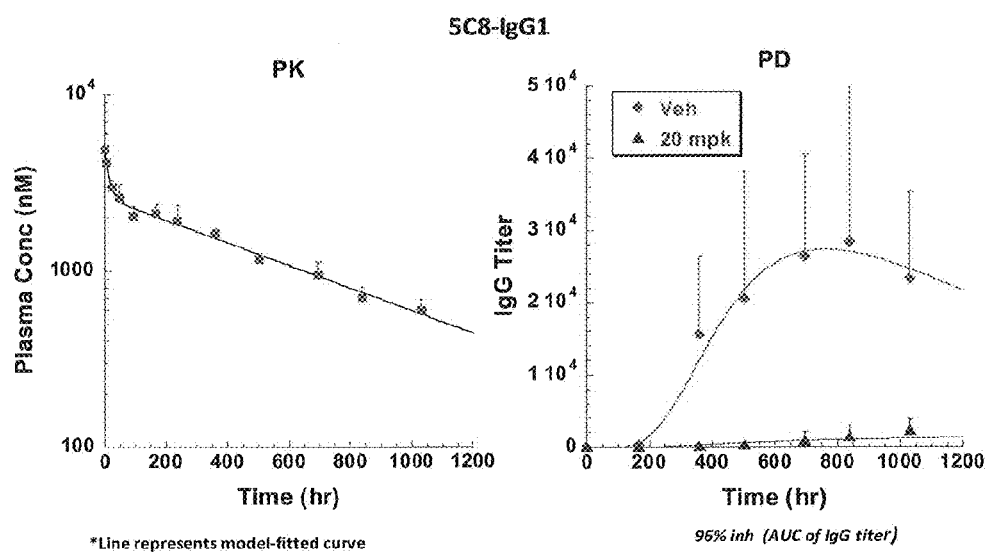

FIG. 21

|  | CDR1 | CDR2 | |
|---|---|---|---|
| BMS2h-572-6   | EVQLLESGGGLVQPGGSLRLSCAASGFTFNWQLMGWVRQAPGKGLEWVSGIEGPGDVTYY | 60 |
| BMS2h-572-608 | EVQLLESGGGLVQPGGSLRLSCAASGFTFNWELMGWARQAPGKGLEWVSGIEGPGDVTYY | 60 |
| BMS2h-572-614 | EVQLLESGGGLVQPGGSLRLSCAASGFTFNWQLMGWVRQAPGKGLEWVSGIEGPGDVTYY | 60 |
| BMS2h-572-619 | EVQLLESGGGLVQPGGSLRLSCAASGFTFNWQLMGWVRQAPGKGLEWVSGIEGPGDVTYY | 60 |
| BMS2h-572-633 | EVQLLESGGGLVQPGGSLRLSCAASGFTFNWELMGWARQAPGKGLEWVSGIEGPGDVTYY | 60 |
| BMS2h-572-634 | EVQLLESGGGLVQPGGSLRLSCAASGFTFNWELMGWARQAPGKGLEWVSGIEGPGDVTYY | 60 |
| BMS2h-572-635 | EVQLLESGGGLVQPGGSLRLSCAASGFTFNWELMGWARQAPGKGLEWVSGIEGPGDVTYY | 60 |
|               | ************************** ****** **********************   |    |

|  | CDR2 | CDR3 | |
|---|---|---|---|
| BMS2h-572-6   | ADSVKGRFTISRDNSKNTLYLQMNSLRAEDTAVYYCVRVGKESNSDYRGQGTLVTVSS | 118 |
| BMS2h-572-608 | ADSVKGRFTISRDNSKNTLYLQMNSLRAEDTAVYYCVKVGKESNSDYRGQGTLVTVSS | 118 |
| BMS2h-572-614 | ADSVKGRFTISRDNSKNTLYLQMNSLRAEDTAVYYCVKVGKDAKSDYRGQGTLVTVSS | 118 |
| BMS2h-572-619 | ADSVKGRFTISRDNSKNTLYLQMNSLRAEDTAVYYCVKVGKDSRSDYRGQGTLVTVSS | 118 |
| BMS2h-572-633 | ADSVKGRFTISRDNSKNTLYLQMNSLRAEDTAVYYCVKVGKDAKSDYRGQGTLVTVSS | 118 |
| BMS2h-572-634 | ADSVKGRFTISRDNSKNTLYLQMNSLRAEDTAVYYCVKVGKDSRSDYRGQGTLVTVSS | 118 |
| BMS2h-572-635 | ADSVKGRFTISRDNSKNTLYLQMNSLRAEDTAVYYCVKVGKDSKSDYRGQGTLVTVSS | 118 |
|               | ********************************** ***   ************** |     |

FIG. 22

|  | CDR1 | CDR2 |  |
|---|---|---|---|
| BMS2h-719-2 | EVQLLESGGGLVQPGGSLRLSCAASGFTFKRYEMMWVRQAPGKGLEWVSSISSDGSFTYY | 60 |
| BMS2h-719-202 | EVQLLESGGGLVQPGGSLRLSCAASGFTFKKYEMMWVRQAPGKGLEWVSSISSDGSFTYY | 60 |
| BMS2h-719-203 | EVQLLESGGGLVQPGGSLRLSCAASGFTFNSYEMMWVRQAPGKGLEWVSSISSDGSFTYY | 60 |
| BMS2h-719-213 | EVQLLESGGGLVQPGGSLRLSCAASGFTFKRYEMMWVRQAPGKGLEWVSSISSDGSFTYY | 60 |
| BMS2h-719-214 | EVQLLESGGGLVQPGGSLRLSCAASGFTFKRYEMMWVRQAPGKGLEWVSSISSDGSFTYY | 60 |
| BMS2h-719-215 | EVQLLESGGGLVQPGGSLRLSCAASGFTFKRYEMMWVRQAPGKGLEWVSSISSDGSFTYY | 60 |
| BMS2h-719-218 | EVQLLESGGGLVQPGGSLRLSCAASGFTFKRYEMMWVRQAPGKGLEWVSSISSDGSFTYY | 60 |
| BMS2h-719-225 | EVQLLESGGGLVQPGGSLRLSCAASGFTFNTYEMQWVRQAPGKGLEWVSSISSDGSFTYY | 60 |
|  | *********************************** *** ******************* |  |

|  | CDR2 | CDR3 |  |
|---|---|---|---|
| BMS2h-719-2   | ADSVKGRFTISRDNSKNTLYLQMNSLRAEDTAVYYCAEPFTEFDYWGHGTLVTVSS | 116 |
| BMS2h-719-202 | ADSVKGRFTISRDNSKNTLYLQMNSLRAEDTAVYYCAEPFTEFDYWGHGTLVTVSS | 116 |
| BMS2h-719-203 | ADSVKGRFTISRDNSKNTLYLQMNSLRAEDTAVYYCAEPFTEFDYWGHGTLVTVSS | 116 |
| BMS2h-719-213 | ADSVKGRFTISRDNSKNTLYLQMNSLRAEDTAVYYCADPFTEMDYWGHGTLVTVSS | 116 |
| BMS2h-719-214 | ADSVKGRFTISRDNSKNTLYLQMNSLRAEDTAVYYCADPFTEFDYWGHGTLVTVSS | 116 |
| BMS2h-719-215 | ADSVKGRFTISRDNSKNTLYLQMNSLRAEDTAVYYCAEPFTELDYWGHGTLVTVSS | 116 |
| BMS2h-719-218 | AESVKGRFTISRDNSKNTLYLQMNSLRAEDTAVYYCAEPFTEFDYWGHGTLVTVSS | 116 |
| BMS2h-719-225 | ADSVKGRFTISRDNSKNTLYLQMNSLRAEDTAVYYCAEPFTEFDYWGHGTLVTVSS | 116 |
|  | * ************************************ **** *********** |  |

FIG. 23

```
BMS2h-503-1    DIQMTQSPSSLSASVGDRVTITCRASHHIQRYLSWYQQKPGKAPKLLILWGSQLQSGVPS  60
BMS2h-503-2    DIQMTQSPSSLSASVGDRVTITCRASHDIQRYLSWYQQKPGKAPKLLILWGSQLQSGVPS  60
               ***************************:*******************************

BMS2h-503-1    RFSGSGSGTDFTLTISSLQPEDFATYYCGQWWAPPQTFGQGTKVEIKR  108
BMS2h-503-2    RFSGSGSGTDFTLTISSLQPEDFATYYCGQWWAPPQTFGQGTKVEIKR  108
               ************************************************
```

FIG. 24

```
BMS2h-116-1312    DIQMTQSPSSLSASVGDRVTITCRASQPIGPDLLWYQQKPGKAPKLLIYQTSILRSGVPS 60
BMS2h-116-1313    DIQMTQSPSSLSASVGDRVTITCRASQPIGPDLLWYQQKPGKAPKLLIYQTSILRSGVPS 60
BMS2h-116-1320    DIQMTQSPSSLSAYVGDRVTITCRASQPIGPDLLWYQQKPGKAPKLLIYQTSILRSGVPS 60
                  ************ *********************************************

BMS2h-116-1312    RFSGSGSETDFTLTISNLQPEDLATYYCQQYWAFPVTFGKGTKVVIKR 108
BMS2h-116-1313    RFSGSGSETDFTLTISNLQPEDFATYYCQQYWAFPVTFGRGTKVVIKR 108
BMS2h-116-1320    RFSGSGSETDFTLTISNLQPEDFAKYYCQQYWAFPVTFGQGTKVVIKR 108
                  ********************** * ************* ********
```

ANTIBODY POLYPEPTIDES THAT ANTAGONIZE CD40L

REFERENCE TO RELATED APPLICATIONS

This application claims the benefit of U.S. Provisional Application No. 61/546,800, filed Oct. 13, 2011, and U.S. Provisional Application No. 61/655,110, filed Jun. 4, 2012, which are herein incorporated by reference in their entirety.

TECHNICAL FIELD

Antibodies and fragments thereof that target CD40L, compositions comprising the same, and methods of using the same for treatment of diseases involving CD40L activity are provided.

SEQUENCE LISTING

The instant application contains a Sequence Listing which has been submitted in ASCII format via EFS-Web and is hereby incorporated by reference in its entirety. Said ASCII copy, created on Oct. 8, 2012, is named 200896US.txt and is 1,222,022 bytes in size.

BACKGROUND

CD40 ligand (CD40L), also known as CD154, gp39, TNF-related activation protein (TRAP), 5c8 antigen, or T-BAM, is a trimeric transmembrane protein of the tumor necrosis factor (TNF) superfamily of molecules. CD40L is primarily expressed on activated T cells, as well as on activated leukocytes, eosinophils, basophils, natural killer cells, mast cells, and non-immune cells such as platelets and activated endothelial cells. CD40L also exists in soluble form (sCD40L) that is produced by microsomal stimulus-dependent cleavage of the membrane-bound CD40L. Most of sCD40L in circulation (>90%) is platelet-derived.

CD40L binds CD40, a type I transmembrane glycoprotein belonging to the TNF receptor (TNFR) family. Although all monomeric, dimeric, and trimeric forms of sCD40L can bind to CD40, the trimeric form of sCD40L has the most potent biological activity through oligomerization of cell surface CD40, a common feature of TNFR family. The highest expression of CD40 has been observed on antigen presenting cells (APCs), such as B cells, macrophages, and dendritic cells, while lower expression of this receptor is noted on a variety of other cell types, including stromal cells and thymic epithelium. The CD40-CD40L interaction is essential for normal T-B cell interactions, including increased co-stimulation, T-cell priming, cytokine production, antibody-class switching and affinity maturation, and antibody and autoantibody production.

The crucial role of CD40-CD40L interactions in immune and inflammatory responses has made them a promising target for treatment of pathological immuno-inflammatory processes. Blockade of CD40-CD40L interactions by means of specific CD40L monoclonal antibodies (mAbs) successfully prevents allograft rejection in primates and treats autoimmune diseases and atherosclerosis in animal models. Montgomery et al., *Transplantation* 74: 1365-1369 (2002).

In humans, two different anti-CD40L mAb clones have been used in clinical trials for treatment of different autoimmune diseases. Maribel et al., *Mol. Immunol.* 45: 937-44 (2008). Monoclonal antibodies, however, can display unusually high incidence of thromboembolic (TE) complications, such as atherothrombotic central nervous system events, myocardial infarction, pulmonary embolism, and deep vein thrombosis. For example, the usefulness of the anti-CD40L mAb clone hu5c8 (anti-CD40L mAb, Biogen) is limited by an unusually high incidence of TE complications. TE by these antibodies is thought to result from the formation of higher-order immune complexes (IC) of the mAbs with membrane-bound CD40L on platelets, or sCD40L shed from platelets, that can ligate and thereby aggregate neighboring platelets via their FcgRIIa receptors, resulting in thrombi formation. The risk of thromboembolism has led to a halt in all ongoing clinical trials. Boumpas et al., *Arthritis & Rheumatism* 48: 719-727 (2003).

SUMMARY

Anti-CD40L antibody antagonists that are less likely to cause platelet aggregation and thus cause thromboembolism are still needed in a clinical setting. Novel antibody polypeptides that specifically bind human CD40L are provided. The antibody polypeptides advantageously do not cause platelet aggregation. The antibody polypeptides are useful in the treatment of diseases involving CD40L activation, including autoimmune diseases, transplant rejection, and allergic responses. The antibody polypeptides comprise a variable domain. Exemplary antibody polypeptides are in the form of a domain antibody (dAb) that contains a single variable domain. Alternatively, the dAbs can be bi-specific reagents that comprise a second variable domain that can bind another antigen, such as human serum albumin (HSA), for example.

An antibody polypeptide is provided comprising a first variable domain that specifically binds human CD40L, wherein the first variable domain comprises the amino acid sequence of one of the variable domains selected from the BMS2h lineage. Further provided is an isolated antibody polypeptide comprising a first variable domain that specifically binds human CD40L, wherein CD40L comprises the amino acid sequence of SEQ ID NO: 1, wherein the amino acid sequence of the first variable domain comprises: (a) a CDR1 region which differs from the CDR1 region of BMS2h-572-633 by up to three amino acids, (b) a CDR2 region which differs from the CDR2 region of BMS2h-572-633 by up to three amino acids, (c) a CDR3 region which differs from the CDR3 region of BMS2h-572-633 by up to three amino acids, (d) a FR1 region which differs from the FR1 region of BMS2h-572-633 by up to three amino acids, (e) a FR2 region which differs from the FR2 region of BMS2h-572-633 by up to three amino acids, (f) a FR3 region which differs from the FR3 region of BMS2h-572-633 by up to three amino acids, and (g) a FR4 region which differs from the FR4 region of BMS2h-572-633 by up to three amino acids; and wherein the antibody polypeptide inhibits binding of CD40L to CD40 with an EC50 of 100 pM to 100 nM. Also provided is an antibody polypeptide, wherein the amino acid sequence of the first variable domain comprises: (a) a CDR1 region which differs from the CDR1 region of BMS2h-572-633 by up to three amino acids, (b) a CDR2 region which differs from the CDR2 region of BMS2h-572-633 by up to three amino acids, and (c) a CDR3 region which differs from the CDR3 region of BMS2h-572-633 by up to three amino acids. Alternatively, the amino acid sequence of the first variable domain can differ from the amino acid sequence of BMS2h-572-633 by up to and including 10 amino acids. Furthermore, the amino acid sequence of the first variable domain can differ from the amino acid sequence of BMS2h-572-633 by up to and including 5 amino acids. The amino acid sequence of the first variable domain can also differ from the amino acid sequence of BMS2h-572-633 by up to and including 2 amino acids. Alternatively, the first variable domain differs from the amino acid sequence of BMS2h-572-633 by 1 amino acid.

Also provided is an antibody polypeptide selected from the lineage group of BMS2h-572, wherein the amino acid sequence of the first variable domain further comprises: (a) a CDR1 region having a sequence Trp-$X_1$-Leu-Met-Gly (SEQ ID NO: 2), wherein $X_1$ is Glu or Gln; (b) a CDR2 region having a sequence Gly-Ile-Glu-Gly-Pro-Gly-Asp-Val-Thr-Tyr-Tyr-Ala-Asp-Ser-Val-Lys-Gly (SEQ ID NO: 3); and (c) a CDR3 region having a sequence Lys-$X_2$-$Y_2$-$Z_2$-Ser-Asp-Tyr (SEQ ID NO: 4), wherein $X_2$ is Asp or Glu, $Y_2$ is Ala or Ser, and $Z_2$ is Lys, Asn, or Arg. Also provided is the antibody polypeptide, wherein the amino acid sequence of the first variable domain further comprises: (a) a FR1 region having a sequence Glu-Val-Gln-Leu-Leu-Glu-Ser-Gly-Gly-Gly-Leu-Val-Gln-Pro-Gly-Gly-Ser-Leu-Arg-Leu-Ser-Cys-Ala-Ala-Ser-Gly-Phe-Thr-Phe-Asn (SEQ ID NO: 5); (b) a FR2 region having a sequence Trp-$X_1$-Arg-Gln-Ala-Pro-Gly-Lys-Gly-Leu-Glu-Trp-Val-Ser (SEQ ID NO: 6), wherein $X_1$ is Ala or Val; (c) a FR3 region having a sequence Arg-Thr-Phe-Ile-Ser-Arg-Asp-Asn-Ser-Lys-Asn-Thr-Leu-Tyr-Leu-Gln-Met-Asn-Ser-Leu-Arg-Ala-Glu-Asp-Thr-Ala-Val-Tyr-Tyr-Cys-Val-Lys-Val-Gly (SEQ ID NO: 7); and (d) a FR4 region having a sequence Arg-Gly-Gln-Gly-Thr-Leu-Val-Thr-Val-Ser-Ser (SEQ ID NO: 8).

Alternatively, the first variable domain of the antibody polypeptide can comprise the amino acid sequence of BMS2h-572-633.

Also provided is an antibody polypeptide selected from the lineage group of BMS2h-719, comprising a first variable domain with the following consensus sequence: Glu-Val-Gln-Leu-Leu-Glu-Ser-Gly-Gly-Gly-Leu-Val-Gln-Pro-Gly-Gly-Ser-Leu-Arg-Leu-Ser-Cys-Ala-Ala-Ser-Gly-Phe-Thr-Phe-$X_1$-$Y_1$-Tyr-Glu-Met-$Z_1$-Trp-Val-Arg-Gln-Ala-Pro-Gly-Lys-Gly-Leu-Glu-Trp-Val-Ser-Ser-Ile-Ser-Ser-Asp-Gly-Ser-Phe-Thr-Tyr-Tyr-Ala-$A_1$-Ser-Val-Lys-Gly-Arg-Phe-Thr-Ile-Ser-Arg-Asp-Asn-Ser-Lys-Asn-Thr-Leu-Tyr-Leu-Gln-Met-Asn-Ser-Leu-Arg-Ala-Glu-Asp-Thr-Ala-Val-Tyr-Tyr-Cys-Ala-$B_1$-Pro-Phe-Thr-Glu-$C_1$-Asp-Tyr-Trp-Gly-His-Gly-Thr-Leu-Val-Thr-Val-Ser-Ser (SEQ ID NO: 9), wherein $X_1$ is Lys or Asn; $Y_1$ is Arg, Lys, Ser, or Thr; $Z_1$ is Met or Gln; $A_1$ is Asp or Glu; $B_1$ is Asp or Glu; and $C_1$ is Phe, Met, or Leu.

Also provided is an antibody polypeptide selected from the lineage group of BMS2h-503, comprising a first variable domain with the following consensus sequence: Asp-Ile-Gln-Met-Thr-Gln-Ser-Pro-Ser-Ser-Leu-Ser-Ala-Ser-Val-Gly-Asp-Arg-Val-Thr-Ile-Thr-Cys-Arg-Ala-Ser-His-$X_1$-Ile-Gln-Arg-Tyr-Leu-Ser-Trp-Tyr-Gln-Gln-Lys-Pro-Gly-Lys-Ala-Pro-Lys-Leu-Leu-Ile-Leu-Trp-Gly-Ser-Gln-Leu-Gln-Ser-Gly-Val-Pro-Ser-Arg-Phe-Ser-Gly-Ser-Gly-Ser-Gly-Thr-Asp-Phe-Thr-Leu-Thr-Ile-Ser-Ser-Leu-Gln-Pro-Glu-Asp-Phe-Ala-Thr-Tyr-Tyr-Cys-Gly-Gln-Trp-Trp-Ala-Pro-Pro-Gln-Thr-Phe-Gly-Gln-Gly-Thr-Lys-Val-Glu-Ile-Lys-Arg (SEQ ID NO: 10), wherein $X_1$ is His or Asp.

Also provided is an antibody polypeptide selected from the lineage group of BMS2h-116, comprising a first variable domain with the following consensus sequence: Asp-Ile-Gln-Met-Thr-Gln-Ser-Pro-Ser-Ser-Leu-Ser-Ala-$X_1$-Val-Gly-Asp-Arg-Val-Thr-Ile-Thr-Cys-Arg-Ala-Ser-Gln-Pro-Ile-Gly-Pro-Asp-Leu-Leu-Trp-Tyr-Gln-Gln-Lys-Pro-Gly-Lys-Ala-Pro-Lys-Leu-Leu-Ile-Tyr-Thr-Ser-Ile-Leu-Arg-Ser-Gly-Val-Pro-Ser-Arg-Phe-Ser-Gly-Ser-Gly-Ser-Gly-Thr-Asp-Phe-Thr-Leu-Thr-Ile-Ser-Asn-Leu-Gln-Pro-Glu-Asp-$Y_1$-Ala-$Z_1$-Tyr-Tyr-Cys-Gln-Gln-Tyr-Trp-Ala-Phe-Pro-Val-Thr-Phe-Gly-$A_1$-Gly-Thr-Lys-Val-Val-Ile-Lys-Arg (SEQ ID NO: 11), wherein $X_1$ is Ser or Tyr; $Y_1$ is Leu or Phe; $Z_1$ is Thr or Lys; and $A_1$ is Lys, Arg, or Gln.

Also provided is an antibody polypeptide comprising a first variable domain that specifically binds human CD40L, wherein the antibody polypeptide is a domain antibody (dAb).

The antibody polypeptide can be a fusion polypeptide comprising the first variable domain and an Fc domain. Alternatively, the fusion polypeptide can comprise an IgG4 Fc domain. The fusion polypeptide also can comprise an IgG1 Fc domain. The fusion polypeptide can also comprise an IgG1 Fe domain. Alternatively, the fusion polypeptide can comprise a CT-Long domain. The fusion polypeptide can also comprise a CT-short domain. Alternatively, the fusion polypeptide can comprise a N297Q Long Fc domain. The fusion polypeptide can alternatively comprise a N297Q Short Fc domain.

Also provided is an antibody polypeptide comprising a first variable domain that specifically binds human CD40L, wherein the antibody polypeptide further comprises a second variable domain that specifically binds a second antigen, wherein the second antigen is an antigen other than human CD40L. The second antigen can be a cluster of differentiation (CD) molecule or a Major Histocompatibility Complex (MHC) Class II molecule. Alternatively, the second antigen can be serum albumin (SA).

Also provided is a nucleic acid encoding any of the antibody polypeptides provided herein. Further contemplated is a vector comprising the nucleic acid. An isolated host cell can comprise such vector.

A pharmaceutical composition is provided comprising a therapeutically-effective amount of the presently provided antibody polypeptide and a pharmaceutically acceptable carrier. The pharmaceutical composition can further comprise an immunosuppressive/immunomodulatory and/or anti-inflammatory agent.

A method of treating an immune disease in a patient in need of such treatment is provided comprising administering to the patient a therapeutically effective amount of the pharmaceutical composition described herein. An exemplary method administers the pharmaceutical composition in combination with an immunosuppressive/immunomodulatory and/or anti-inflammatory agent. The immune disease can be an autoimmune disease or a graft-related disease. Alternatively, the immune disease is a graft-related disease. Furthermore, the graft-related disease can comprise solid organ, tissue and/or cell transplant rejection. Alternatively, the graft-related disease is graft versus host disease (GVHD). The graft-related disease can further be an acute transplant rejection. Alternatively, the graft-related disease can be a chronic transplant rejection.

Also provided is the method of treating a graft-related disease, wherein the pharmaceutical composition is co-administered with a CTLA4 mutant molecule. The CTLA4 mutant molecule can be L104EA29Y-Ig (belatacept).

A method of treating an immune disease in a patient in need of such treatment is also provided comprising administering to the patient a therapeutically effective amount of the pharmaceutical composition provided herein, wherein the immune disease is selected from the group consisting of selected from the group consisting of Addison's disease, allergies, ankylosing spondylitis, asthma, atherosclerosis, autoimmune diseases of the ear, autoimmune diseases of the eye, autoimmune hepatitis, autoimmune parotitis, colitis, coronary heart disease, Crohn's disease, diabetes, including Type 1 and/or Type 2 diabetes, epididymitis, glomerulonephritis, Graves' disease, Guillain-Barre syndrome, Hashimoto's disease, hemolytic anemia, idiopathic thrombocytopenic purpura, inflammatory bowel disease, immune response to recombinant drug products, systemic lupus erythematosus, male infertility, multiple sclerosis, myasthenia gravis, pemphigus, psoriasis, rheumatic fever, rheumatoid arthritis, sarcoidosis, scleroderma, Sjogren's syndrome, spondyloarthropathies, thyroiditis, transplant rejection, vasculitis, AIDS, atopic allergy, bronchial asthma, eczema, leprosy, schizophrenia, inherited depression, transplantation of tissues and organs, chronic fatigue syndrome, Alzheimer's disease, Parkinson's disease, myocardial infarction, stroke, autism, epilepsy, Arthus's phenomenon, anaphylaxis, alcohol addiction, and drug addiction. Alternatively, the immune disease can be myasthenia gravis, idiopathic thrombocytopenic purpura, or systemic sclerosis.

Also provided is a use of an isolated antibody polypeptide disclosed herein for the preparation of a medicament for the treatment of a patient, wherein the patient has or is at risk of having an immune disease. Further provided is a use of an isolated antibody polypeptide disclosed herein for preparation of a medicament for alleviating at least one symptom of an immune disease in a patient in need thereof.

Further provided herein is an isolated antibody polypeptide comprising a first variable domain, wherein said antibody polypeptide specifically binds human CD40L, wherein CD40L comprises the amino acid sequence of SEQ ID NO: 1, wherein the antibody polypeptide competes, with the binding of BMS2h-572-633, and wherein the antibody polypeptide inhibits binding of CD40L to CD40 with an EC50 of 100 pM to 100 nM. In one aspect, the first variable domain comprises the amino acid sequence of one of the antibody polypeptides selected from the lineage group consisting of BMS2h-572, BMS2h-719, BMS2h-503, and BMS2h-116. In another aspect, the first variable domain comprises an amino acid sequence at least 95% identical to BMS2h-572-6, BMS2h-572-608, BMS2h-572-614, BMS2h-572-619, BMS2h-572-633, BMS2h-572-634, BMS2h-572-635, BMS2h-719-2, BMS2h-719-202, BMS2h-719-203, BMS2h-719-213, BMS2h-719-214, BMS2h-719-215, BMS2h-719-218, BMS2h-719-225, BMS2h-503-1, BMS2h-503-2, BMS2h-116-1312, BMS2h-116-1313, or BMS2h-116-1320. In yet another aspect, the first variable domain comprises the amino acid sequence of BMS2h-572-6, BMS2h-572-608, BMS2h-572-614, BMS2h-572-619, BMS2h-572-633, BMS2h-572-634, BMS2h-572-635, BMS2h-719-2, BMS2h-719-202, BMS2h-719-203, BMS2h-719-213, BMS2h-719-214, BMS2h-719-215, BMS2h-719-218, BMS2h-719-225, BMS2h-503-1, BMS2h-503-2, BMS2h-116-1312, BMS2h-116-1313, or BMS2h-116-1320.

BRIEF DESCRIPTION OF THE FIGURES

The patent or application file contains at least one drawing executed in color. Copies of this patent or patent application publication with color drawing(s) will be provided by the Office upon request and payment of the necessary fee.

FIG. 3 provides sequences (SEQ ID NOS 1356-1361, respectively, in order of appearance) of various Fc domains. Linker regions are shown in boxes.

FIG. 4 shows examples of various Fc-formatted domain antibodies (SEQ ID NOS 1362-1365, respectively, in order of appearance). Linker regions are indicated by boxes.

FIG. 14 demonstrates PK/PD modeling of BMS-986003 and 5c8-IgG1 plasma exposures and anti-KLH antibody response (IgG Titers).

FIGS. 21, 22, 23, and 24 show is ClustalW2 alignments of representative domain antibody polypeptides from lineages BMS2h-572, BMS2h-719, BMS2h-503, and BMS2h-116, respectively. FIG. 21 discloses SEQ ID NOS 243, 251, 257, 262 and 274-276, respectively, in order of appearance, FIG. 22 discloses SEQ ID NOS 352, 354-355 and 357-361, respectively, in order of appearance, FIG. 23 discloses SEQ ID NOS 1087-1088, respectively, in order of appearance, and FIG. 24 discloses SEQ ID NOS 970-971 and 974, respectively, in order of appearance.

DETAILED DESCRIPTION

Figures 1A, 1B:
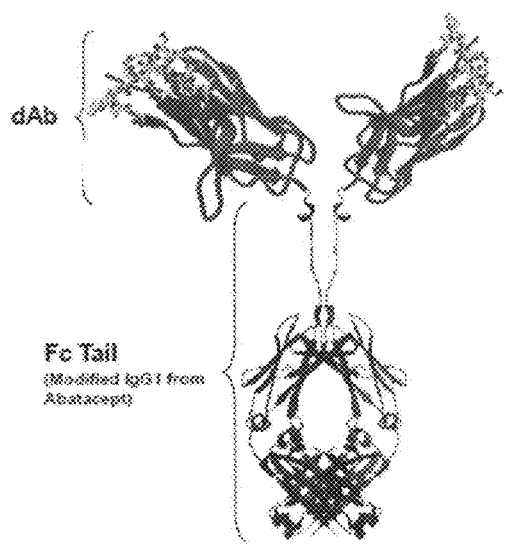
FIG. 1A depicts the domain antibody that comprises a $V_H$ variable domain BMS2h-572-633 fused to a modified Fc tail from Abatacept IgG1.
FIG. 1B shows the amino acid sequence (SEQ ID NO: 1355) of the variable domain BMS2h-572-633 (in blue). The Fc fusion protein is a dimer of molecular weight 77,984 Daltons, with each polypeptide chain consisting of 354 amino acids. The variable domain is fused by a linker (green) to the mutated Fc construct of human IgG1, wherein three cysteine residues (shown in purple) are substituted with serine, and one proline (shown in red) is substituted with a senile residue.
Figure 2:
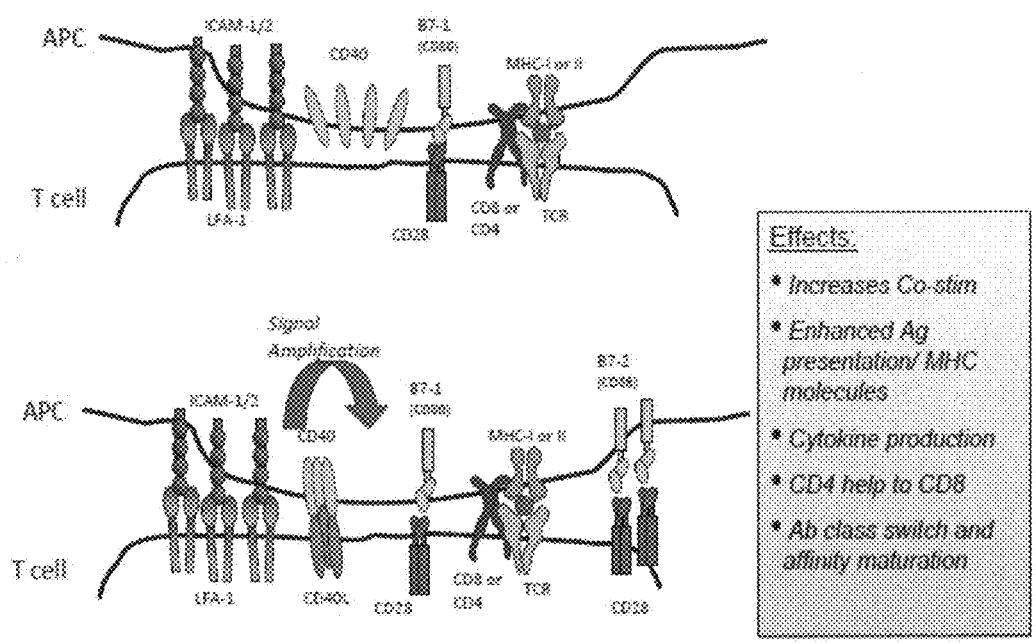
FIG. 2 depicts a working model for the CD40-40L pathway. The top panel demonstrates initial stages of an encounter between a T cell and an APC. The initial encounter driven by T cell receptor (TCR) engagement of pMHC complex (signal 1) coupled with an early CD28-CD80 interaction (signal 2) is sufficient for the cell surface expression of trimeric CD40L (bottom panel). Engagement of CD40 by CD40L results in numerous biological responses outlined in the grey box.

Antibody polypeptides that specifically bind to human CD40L are provided. The antibody polypeptides do not activate platelets, and the antibody polypeptides are useful in the treatment of diseases involving CD40L activation, such as graft-related diseases and autoimmune diseases. The antibody polypeptides may be selected using a primary screen that utilizes cell binding assays, followed by one or more rounds of error-prone or degenerate oligonucleotide-directed affinity maturation. As a result, a genus of antibody polypeptides that specifically bind CD40L are provided.

A "lineage" is a set of related antibody polypeptides that were prepared from a common precursor by error-prone or degenerate oligonucleotide-directed affinity maturation, as disclosed in the examples below, and that are expected to bind CD40L. The nomenclature of the antibody polypeptides is used to designate the various lineages. The nomenclature "BMS2h-572," for example, refers to antibody polypeptides of lineage 572, which were raised against human CD40L. "Lineage BMS2h-572" antibody polypeptides include BMS2h-572-1 through BMS2h-572-19, BMS2h-572-21 through BMS2h-572-24, BMS2h-572-601 through BMS2h-572-627, and BMS2h-572-630 through BMS2h-572-635.

Accordingly, in one aspect, an antibody polypeptide comprises a variable domain that specifically binds human CD40L, where the antibody polypeptide competes with the binding of any one of the domain antibodies (dAbs) listed in TABLE 1 or TABLE 3. For example, the antibody polypeptide may compete with a dAb selected from the 2 h lineage. The dAb also may be selected from a lineage selected from the group consisting of BMS2h-116, BMS2h-503, BMS2h-572, and BMS2h-719, such as the dAb BMS2h-572-633, BMS2h-572-608, or BMS2h-572-614, for instance. In another aspect, an antibody polypeptide specifically binds human CD40L as any one of the dAbs listed in TABLE 1 and TABLE 3. For example, the antibody polypeptide may comprise a variable domain that specifically binds human CD40L as the dAb BMS2h-572-633, BMS2h-572-608, or BMS2h-572-614, for instance.

The antibody polypeptides may be a domain antibody containing a single variable domain The antibody polypeptides also may comprise additional domains, such as an Fc domain. For instance, the antibody polypeptide may comprise a second variable domain that specifically binds human serum albumin (HSA). Such dual specific antibody polypeptides may have an increased half-life, for example.

As used herein, "specific binding" refers to the binding of an antigen by an antibody polypeptide with a dissociation constant ($K_d$) of about 1 μM or lower as measured, for example, by surface plasmon resonance (SPR). Suitable assay systems include the BIAcore™ surface plasmon resonance system and BIAcore™ kinetic evaluation software (e.g., version 2.1). The affinity or $K_d$ for a specific binding interaction may be about 1 μM or lower, about 500 nM or lower or about 300 nM or lower.

The term "about" will be understood by persons of ordinary skill in the art and will vary to some extent on the context in which it is used. Generally, about encompasses a range of values that are plus/minus 10% of a referenced value.

In accordance with this detailed description, the following abbreviations and definitions apply. It must be noted that as used herein, the singular forms "a", "an", and "the" include plural referents unless the context clearly dictates otherwise. Thus, for example, reference to "an antibody" includes a plurality of such antibodies and reference to "the dosage" includes reference to one or more dosages and equivalents thereof known to those skilled in the art, and so forth.

1. CD40L and CD40L Activities

Antibody polypeptides are provided that bind human CD40L. CD40L is also known as CD154, gp39, TNF-related activation protein (TRAP), 5c8 antigen, or T-BAM. Relevant structural information for human CD40L can be found, for example, at UniProt Accession Number P29965. "Human CD40L" refers to the CD40L comprising the following amino acid sequence:

```
                                          (SEQ ID NO: 1)
          10          20          30          40
   MIETYNQTSP  RSAATGLPIS  MKIFMYLLTV  FLITQMIGSA 50          60          70          80
   LFAVYLHRRL  DKIEDERNLH  EDFVFMKTIQ  RCNTGERSLS 90         100         110         120
   LLNCEEIKSQ  FEGFVKDIML  NKEETKKENS  FEMQKGDQNP 130         140         150         160
   QIAAHVISEA  SSKTTSVLQW  AEKGYYTMSN  NLVTLENGKQ 170         180         190         200
   LTVKRQGLYY  IYAQVTFCSN  REASSQAPFI  ASLCLKSPGR 210         220         230         240
   FERILLRAAN  THSSAKPCGQ  QSIHLGGVFE  LQPGASVFVN 250         260
   VTDPSQVSHG  TGFTSFGLLK  L
```

CD40L has also been sequenced in *Sus scrofa*, *Mus musculus*, *Canis familiaris*, *Bos ffini*, *Macaca mulatto*, *Aotus tivirgatus*, *Callithrix jacchus*, *Cercocebus torquatus atys*, *Macaca nemestrina*, *Rattus norvegicus*, *Gallus gallus*, *Fells catus*, and *Sus scrofa*.

Binding of the present antibody polypeptides to CD40L antagonizes CD40L activity. "CD40L activities" include, but are not limited to, costimulation and activation an APC in association with T cell receptor stimulation by MHC molecules on the APC, secretion of all immunoglobulin isotypes in the presence of cytokines, stimulation of B cell proliferation, cytokine production, antibody class switching and affinity maturation. For example, patients with X-linked hyper-IgM syndrome express functional CD40 on their B cells, but their activated T cells have a defective CD40L protein, resulting in its inability to activate B cells and induce immunoglobulin isotype switching. Aruffo et al., *Cell* 72:291-300 (1993).

CD40L activities can be mediated by interaction with other molecules. "CD40 activities" include the functional interaction between CD40L and the following molecules: CD40 (CD40L receptor), α5β1 integrin, and αIIbβ3. For example, CD40L binds its receptor, CD40, which is expressed on a variety of APCs, such as B cells, macrophages, and dendritic cells, as well as on stromal cells, vascular endothelial cells, and platelets.

As used herein, the terms "activate," "activates," and "activated" refer to an increase in a given measurable CD40L activity by at least 10% relative to a reference, for example, at least 10%, 25%, 50%, 75%, or even 100%, or more. A CD40L activity is "antagonized" if the activity is reduced by at least 10%, and in an exemplary embodiment, at least 20%, 30%, 40%, 50%, 60%, 70%, 80%, 90%, 95%, 97%, or even 100% (i.e., no detectable activity), relative to the absence of the antagonist. For example, an antibody polypeptide may antagonize some or all CD40L activity. In one embodiment, the antibody polypeptide does not activate B cell proliferation. In another embodiment, the antibody polypeptide does not activate cytokine secretion by T cells or dendritic cells (DCs), where the cytokine is at least one cytokine selected from the group consisting of IL-2, IL-6, IL-10, IL-12, IL-13, IL-17, IL-23, TNF-α, and IFN-γ.

2. Antibody Polypeptides

The antibody polypeptides comprise a variable domain. In one embodiment, the antibody polypeptides are in the form of a dAb that contains a single variable domain. Antibody polypeptides may be full-length anti-CD40L immunoglobulin molecules comprising two heavy (H) chains and two light (L) chains interconnected by disulfide bonds. In this embodiment, the amino terminal portion of each chain includes a variable domain ($V_L$ or $V_H$) of about 100-120 amino acids. The complementarity determining regions (CDRs) contained therein are primarily responsible for antigen recognition, although framework residues can play a role in epitope binding. The carboxy-terminal "half" of each heavy chain defines a constant region (Fc) primarily responsible for effector function.

Antibody polypeptides also may be "fragments" comprising a portion of the full-length anti-CD40L immunoglobulin molecule that comprises a variable domain that specifically binds CD40L. Thus, the term "antibody polypeptides" includes an antigen-binding heavy chain, light chain, heavy chain-light chain dimer, Fab fragment, F(ab')$_2$ fragment, Fv fragment, single chain Fv (scFv), and dAb, for example. The term "antibody polypeptides" thus includes polypeptides made by recombinant engineering and expression, as well as monoclonal antibodies produced by natural recombination and secretion by hybridoma cell clones.

Light chains are classified as kappa (κ) or lambda (λ), and are characterized by a particular constant region, $C_L$, as known in the art. Heavy chains are classified as γ, μ, α, δ, or ε, and define the isotype of an antibody as IgG, IgM, IgA, IgD, or IgE, respectively. The heavy chain constant region is comprised of three domains (CH1, CH2, and CH3) for IgG, IgD, and IgA; and four domains (CH1, CH2, CH3, and CH4) for IgM and IgE. Anti-CD40L antibodies may have a heavy chain constant region selected from any of the immunoglobulin classes (IgA, IgD, IgG, IgM, and IgE).

Each light chain variable domain ($V_L$) and heavy chain variable domain ($V_H$) is composed of three CDRs and four framework regions (FRs), arranged from amino-terminus to carboxy-terminus in the following order: FR1, CDR1, FR2, CDR2, FR3, CDR3, and FR4. The three CDRs of the light chain are referred to as "LCDR1, LCDR2, and LCDR3" and the three CDRs of the heavy chain are referred to as "HCDR1, HCDR2, and HCDR3."

As used herein, the term "Fc domain" refers to the constant region antibody sequences comprising CH2 and CH3 constant domains as delimited according to Kabat et al., *Sequences of Immunological Interest*, 5$^{th}$ ed., U.S. Dept. Health & Human Services, Washington, D.C. (1991). The Fc domain may be derived from an IgG1 or an IgG4 Fc region, for example.

A variable domain may be fused to an Fc domain. Examples of various Fc-formatted domain antibodies and their potency are provided in TABLE 6. FIG. 3 provides sequences of various Fc domains provided herein. Linker regions are shown in boxes. As used in TABLE 6, "Fc" indicates that the dAb is fused to a human IgG1 short Fc. "CT Long Fc," also called CT-L2, refers to the Fc from CTLA4. The underlined S are cysteine-to-serine point mutations made to eliminate the disulfides in the Fc hinge. "CT Short," also called CT-S1, is shorter than CT Long by 7 amino acids. "N297Q Long Fc," also referred to as N297Q-L4, is the Fc domain of human IgG1 with a N297Q mutation made to eliminate the N-linked carbohydrate in the Fc. "N297Q Short Fe," also called N297Q-S3, is short than N297Q Long Fc by 7 amino acids, and is a human IgG1 with a N297Q point mutation made to eliminate the N-linked carbohydrate in the Fc domain. "CT-Fc SP5" is the CT Long Fc, where SP5 refers to the octeonectin signal peptide used for secretion from the mammalian expression host. Cleavage site is indicated by "^". FIG. 4 further provides examples of various Fc domain formats.

When a variable domain is fused to an Fc domain, the carboxyl terminus of the variable domain (either a $V_L$ or $V_H$ domain, including dAbs) may be linked or fused to the amino terminus of the Fc CH2 domain. Alternatively, the carboxyl terminus of the variable domain may be linked or fused to the amino terminus of a CH1 domain, which itself is fused to the Fc CH2 domain. The protein may comprise the hinge region between the CH1 and CH2 domains in whole or in part.

The CDRs contain most of the residues that form specific interactions with the antigen. In one embodiment, the variable domain of an antibody polypeptide comprises CDR1, CDR2, and CDR3 regions that have the same amino acid sequence as the CDR1, CDR2, and CDR3 regions of one of the dAbs listed in TABLE 1 or TABLE 3 or that each differ from the CDR1, CDR2, and CDR3 regions by one, two, or three amino acids. For example, the antibody polypeptide may comprise CDR1, CDR2, and CDR3 regions that have the same amino acid sequence as the CDR1, CDR2, and CDR3 regions of BMS2h-572-633, BMS2h-572-608, or BMS2h-572-614, for example.

A "domain antibody" (dAb) comprises a single variable ($V_L$ or $V_H$) domain that is capable of specifically and monovalently binding an antigen, such as CD40L. For example, a dAb may have a $V_{HH}$ structure, characteristic of a camelid dAb. A "$V_H$ domain" as used herein is meant to include a $V_{HH}$ structure. In another embodiment, the $V_H$ domains (including all features and combination of features presented as embodiments herein) are other than $V_{HH}$ domains. dAbs may form homo- or heterodimers in solution. While not limited by any particular theory, it is believed that the dAbs disclosed herein do not cause platelet aggregation, because the antibodies containing mutated Fc constructs do not bind FcγRIIa (also known as CD32a) on the platelet surface and do not activate platelets.

As used herein, the term "variable domain" refers to immunoglobulin variable domains defined by Kabat et al., *Sequences of Immunological Interest*, 5$^{th}$ ed., U.S. Dept. Health & Human Services, Washington, D.C. (1991). The numbering and positioning of CDR amino acid residues within the variable domains is in accordance with the well-known Kabat numbering convention.

The term "human," when applied to antibody polypeptides, means that the antibody polypeptide has a sequence, e.g., framework regions and/or CH domains, derived from a human immunoglobulin. A sequence is "derived from" a human immunoglobulin coding sequence when the sequence is either: (a) isolated from a human individual or from a cell or cell line from a human individual; (b) isolated from a library of cloned human antibody gene sequences or of human antibody variable domain sequences; or (c) diversified by mutation and selection from one or more of the polypeptides above. An "isolated" compound as used herein means that the compound is removed from at least one component with which the compound is naturally associated with in nature.

Antibody polypeptides can be administered to human patients while largely avoiding the anti-antibody immune response often provoked by the administration of antibodies from other species, e.g., mouse. For example, murine antibodies can be "humanized" by grafting murine CDRs onto a human variable domain FR, according to procedures well known in the art. Human antibodies as disclosed herein, however, can be produced without the need for genetic manipulation of a murine antibody sequence.

Variable domains may comprise one or more FR with the same amino acid sequence as a corresponding framework region encoded by a human germline antibody gene segment. For example, a domain antibody may comprise the $V_H$ germline gene segments DP47, DP45, or DP38, the $V_\kappa$ germline gene segment DPK9, the $J_H$ segment JH4b, or the $J_\kappa$ segment $J_\kappa 1$.

Changes may be made to antibody polypeptide sequences while retaining the ability to bind CD40L specifically. Specifically, the antibody polypeptides (e.g., a dAb) may comprise a variant variable domain that retains the function of specifically binding CD40L as the dAb BMS2h-572-633. In one embodiment, the variant variable domain may compete with BMS2h-572-633 for specific binding to CD40L. Error-prone affinity maturation, as disclosed in the examples below, provides one exemplary method for making and identifying antibody polypeptides with variant sequences that specifically bind CD40L.

For example, a variant variable domain may differ from one of the variable domains listed in TABLE 1 and TABLE 3 by up to 10 amino acids or any integral value between, where the variant variable domain specifically binds CD40L. Alternatively, the variant variable domain may have at least 90% sequence identity (e.g., at least 91%, 92%, 93%, 94%, 95%, 96%, 97%, 98%, or 99% sequence identity) relative to a sequence listed in the present Sequence Listing. Non-identical amino acid residues or amino acids that differ between two sequences may represent amino acid substitutions, additions, or deletions. Residues that differ between two sequences appear as non-identical positions, when the two sequences are aligned by any appropriate amino acid sequence alignment algorithm, such as BLAST.

In one embodiment, amino acid substitutions may be made to individual FR regions, such that a FR comprises 1, 2, 3, 4, or 5 amino acid differences relative to the amino acid sequence of the corresponding FR encoded by a human germline antibody gene segment. In another embodiment, the variant variable domain may contain one or two amino acid substitutions in a CDR. In other embodiments, amino acid substitutions to FR and CDR regions may be combined. Representative variable domains that specifically bind CD40L are listed in TABLE 1 and TABLE 3.

The information regarding the boundaries of the $V_L$ or $V_H$ domains of heavy and light chain genes may be used to design PCR primers to amplify the variable domain from a cloned heavy or light chain coding sequence encoding an antibody polypeptide known to bind CD40L. The amplified variable domain may be inserted into a suitable expression vector, e.g., pHEN-1 (Hoogenboom et al. (1991) *Nucleic Acids Res.* 19:4133-4137) and expressed, either alone or as a fusion with another polypeptide sequence, using techniques well known in the art. Based on the disclosed amino acid and polynucleotide sequences, the fusion protein can be produced and purified using only ordinary skill in any suitable mammalian host cell line, such as CHO, 293, COS, NSO, and the like, followed by purification using one or a combination of methods, including protein A affinity chromatography, ion exchange, reverse phase techniques, or the like.

In one aspect, the antibody polypeptide is a "dual specific" antibody polypeptide comprising a first variable domain that specifically binds human CD40L. Dual specific antibody polypeptides comprise a second variable domain that specifically binds a second antigen that is other than human CD40L.

In another embodiment, the second antigen may be a cell surface molecule of an immune effector cell or a soluble molecule such as a cytokine, for example. Binding of the dual specificity antibody polypeptide could be used to antagonize CD40L and antagonize a biological activity of the second antigen. Cell surface molecules of immune effector cells include the cluster of differentiation (CD) molecules. Representative CD markers are listed on the Internet at hypertext transfer protocol http://en.wikipedia.org/wiki/List_of_human_clusters_of_differentiation (last modified on Aug. 8, 2012). Cell surface molecules of immune effector cells also include Major Histocompatibility Complex (MHC) Class II molecules. Antibodies against these cell surface molecules are known in the art and can be used a source of a variable domain to construct a dual specific antibody polypeptide.

In one embodiment, antibody polypeptides of a dual specific ligand may be linked by an "amino acid linker" or "linker." For example, a dAb may be fused to the N-terminus of an amino acid linker, and another dAb may be fused to the C-terminus of the linker. Although amino acid linkers can be any length and consist of any combination of amino acids, the linker length may be relatively short (e.g., five or fewer amino acids) to reduce interactions between the linked domains. The amino acid composition of the linker also may be adjusted to reduce the number of amino acids with bulky side chains or amino acids likely to introduce secondary structure. Suitable amino acid linkers include, but are not limited to, those up to 3, 4, 5, 6, 7, 10, 15, 20, or 25 amino acids in length. Representative amino acid linker sequences include $(GGGGS)_n$ (SEQ ID NO: 12), where n may be any integer between 1 and 5. Other suitable linker sequences may be selected from the group consisting of AS, AST, TVAAPS (SEQ ID NO: 13), TVA, and ASTSGPS (SEQ ID NO: 14).

The binding of the second antigen can increase the in vivo half-life of the antibody polypeptide. For example, the second variable domain of the dual specific antibody polypeptide may specifically bind serum albumin (SA), e.g., human serum albumin (HSA). The antibody polypeptide formatted to bind I can have an increased in vivo t-α ("alpha half-life")

or t-β ("beta half-life") half-life relative to the same unformatted antibody polypeptide. The t-α and t-β half-lives measure how quickly a substance is distributed in and eliminated from the body. The linkage to I may be accomplished by fusion of the antibody polypeptide with a second variable domain capable of specifically binding I, for example. Anti-human serum albumin antibodies are well-known in the art. See, e.g., Abcam®, Human Serum Albumin antibodies ab10241, ab2406, and ab8940, available on the Internet at hypertext transfer protocol www.abcana.com/index.html, or GenWay, ALB antibody, available on the Internet at hypertext transfer protocol www.genwaybio.com. Variable domains that specifically bind I can be obtained from any of these antibodies, and then fused to an antibody polypeptide of the disclosure using recombinant techniques that are well known in the art.

Alternatively, the linking of the antibody polypeptide to I can be accomplished by directly fusing the antibody polypeptide sequence to an I coding sequence using techniques well known to the skilled artisan. The I coding sequences can be obtained by PCR using primers derived from the cDNA sequence available at GenBank Accession No. NM000477, for example.

In one embodiment, the tα-half-life of the I-linked domain antibody composition is increased by 10% or more. In another embodiment, the tα-half-life of the I-linked domain antibody composition is in the range of 0.25 hours to 6 hours. In another embodiment, the tβ-half-life of the I-linked domain antibody composition is increased by 10% or more. In another embodiment, the tβ-half-life of the I-linked domain antibody composition is in the range of 12 to 48 hours.

In another embodiment, an antibody polypeptide may be formatted to increase its in vivo half-life by PEGylation. In one embodiment, the PEG is covalently linked. In another embodiment, the PEG is linked to the antibody polypeptide at a cysteine or lysine residue. In yet another embodiment, the PEG-linked antibody polypeptide has a hydrodynamic size of at least 24 kD. In yet another embodiment, the total PEG size is from 20 to 60 kD, inclusive. In yet another embodiment, the PEG-linked domain antibody has a hydrodynamic size of at least 200 kD.

PEGylation can be achieved using several PEG attachment moieties including, but not limited to N-hydroxylsuccinimide active ester, succinimidyl propionate, maleimide, vinyl sulfone, or thiol. A PEG polymer can be linked to an antibody polypeptide at either a predetermined position, or can be randomly linked to the domain antibody molecule. PEGylation can also be mediated through a peptide linker attached to a domain antibody. That is, the PEG moiety can be attached to a peptide linker fused to an antibody polypeptide, where the linker provides the site (e.g., a free cysteine or lysine) for PEG attachment. Methods of PEGylating antibodies are well known in the art, as disclosed in Chapman, et al., "PEGylated antibodies and antibody fragments for improved therapy: a review," *Adv. Drug Deliv. Rev.* 54(4):531-45 (2002), for example.

Antibody polypeptides also may be designed to form a dimer, trimer, tetramer, or other multimer. Antibody polypeptides, e.g., dAbs, can be linked to form a multimer by several methods known in the art, including, but not limited to, expression of monomers as a fusion protein, linkage of two or more monomers via a peptide linker between monomers, or by chemically joining monomers after translation, either to each other directly, or through a linker by disulfide bonds, or by linkage to a di-, tri- or multivalent linking moiety (e.g., a multi-arm PEG). In one embodiment, the multimer can bind a single molecule of CD40.

3. Pharmaceutical Compositions and Methods of Treatment

A pharmaceutical composition comprises a therapeutically-effective amount of one or more antibody polypeptides and optionally a pharmaceutically acceptable carrier. Pharmaceutically acceptable carriers include, for example, water, saline, phosphate buffered saline, dextrose, glycerol, ethanol and the like, as well as combinations thereof. Pharmaceutically acceptable carriers can further comprise minor amounts of auxiliary substances, such as wetting or emulsifying agents, preservatives, or buffers that enhance the shelf-life or effectiveness of the fusion protein. The compositions can be formulated to provide quick, sustained, or delayed release of the active ingredient(s) after administration. Suitable pharmaceutical compositions and processes for preparing them are well known in the art. See, e.g., Remington, THE SCIENCE AND PRACTICE OF PHARMACY, A. Gennaro, et al., eds., 21$^{st}$ ed., Mack Publishing Co. (2005).

The pharmaceutical composition further may comprise an immunosuppressive/immuno-modulatory and/or anti-inflammatory agent. A method of treating an immune disease in a patient in need of such treatment may comprise administering to the patient a therapeutically effective amount of the pharmaceutical composition. Antagonizing CD40L-mediated T cell activation could inhibit undesired T cell responses occurring during autoimmunity, transplant rejection, or allergic responses, for example. Inhibiting CD40L-mediated T cell activation could moderate the progression and/or severity of these diseases.

As used herein, a "patient" means an animal, e.g. mammal, including humans. The patient may be diagnosed with an immune disease. "Treatment" or "treat" or "treating" refers to the process involving alleviating the progression or severity of a symptom, disorder, condition, or disease. An "immune disease" refers to any disease associated with the development of an immune reaction in an individual, including a cellular and/or a humoral immune reaction.

Examples of immune diseases include, but are not limited to graft-related disease, inflammation, allergy, and autoimmune disease. The autoimmune disease may be selected from the group consisting of systemic lupus erythematosus, multiple sclerosis, rheumatoid arthritis, diabetes, psoriasis, scleroderma, atherosclerosis, inflammatory bowel disease, and ulcerative colitis.

Diseases that can be treated by administering the pharmaceutical composition may be selected from the group consisting of Addison's disease, allergies, ankylosing spondylitis, asthma, atherosclerosis, autoimmune diseases of the ear, autoimmune diseases of the eye, autoimmune hepatitis, autoimmune parotitis, colitis, coronary heart disease, Crohn's disease, diabetes, including Type 1 and/or Type 2 diabetes, epididymitis, glomerulonephritis, Graves' disease, Guillain-Barre syndrome, Hashimoto's disease, hemolytic anemia, idiopathic thrombocytopenic purpura, inflammatory bowel disease, immune response to recombinant drug products (e.g., Factor VII in hemophiliacs), systemic lupus erythematosus, male infertility, multiple sclerosis, myasthenia gravis, pemphigus, psoriasis, rheumatic fever, rheumatoid arthritis, sarcoidosis, scleroderma, Sjogren's syndrome, spondyloarthropathies, thyroiditis, transplant rejection, and vasculitis. Autoimmune-mediated conditions include, but are not limited to, conditions in which the tissue affected is the primary target, and in some cases, the secondary target. Such conditions include, but are not limited to, AIDS, atopic allergy, bronchial asthma, eczema, leprosy, schizophrenia, inherited depression, transplantation of tissues and organs, chronic fatigue syndrome, Alzheimer's disease, Parkinson's disease, myocardial infarction, stroke, autism, epilepsy, Arthus' phenomenon, anaphylaxis, alcohol addiction, and drug addiction.

Preferred indications for administration of the present pharmaceutical compositions are, for example, immune thrombocytopenic purpura, systemic sclerosis, myasthenia gravis, allograft rejection, and graft-versus-host disease.

The pharmaceutical composition may be administered alone or in combination therapy, (i.e., simultaneously or sequentially) with an immunosuppressive/immunomodulatory and/or anti-inflammatory agent. Different immune diseases can require use of specific auxiliary compounds useful for treating immune diseases, which can be determined on a patient-to-patient basis. For example, the pharmaceutical composition may be administered in combination with one or more suitable adjuvants, e.g., cytokines (IL-10 and IL-13, for example) or other immune stimulators, e.g., chemokines, tumor-associated antigens, and peptides. Suitable adjuvants are known in the art.

For example, the disclosed pharmaceutical composition may be co-administered, concomitantly or sequentially, with a cytotoxic T-lymphocyte antigen 4 (CTLA4) mutant molecule, such as L104EA29Y-Ig (belatacept). CTLA4 binds to CD80 (B7-1) and CD86 (B7-2) with higher avidity than CD28, and it is transiently expressed on T cells following their activation, where it interrupts the interaction between CD28 and CD80/86. Oosterwegel et al., *Curr. Opin. Immunol.* 11: 294-300 (1999). This creates a negative feedback signal for T cell activation.

CTLA4 mutant molecules, including L104EA29Y-Ig, have increased binding avidity to CD80/86 compared to wild-type CTLA4. Intervention of the CD28-CD80/86 pathway by L104EA29Y-Ig has been successfully pursued, for example, to treat graft-related diseases in non-human primate transplant models, alone or in combination with other immunosuppressive agents. Larsen et al., *Amer. J. Transplant.* 5: 443 (2005). U.S. Patent Application number 2010/0166774 describes the structure of L104EA29Y-Ig, methods of producing it, and a formulation comprising a CTLA4 molecule; and the application is herein incorporated by reference. U.S. Pat. Nos. 7,094,874 and 7,482,327 further disclose administration (including co-administration with one or more other drugs) and dosage schedule of L104EA29Y-Ig, and the disclosures of these patents are herein incorporated by reference.

Any suitable method or route can be used to administer the antibody polypeptide or the pharmaceutical composition. Routes of administration include, for example, oral, intravenous, intraperitoneal, subcutaneous, or intramuscular administration. A therapeutically effective dose of administered antibody polypeptide(s) depends on numerous factors, including, for example, the type and severity of the immune disease being treated, the use of combination therapy, the route of administration of the antibody polypeptide(s) or pharmaceutical composition, and the weight of the patient. A non-limiting range for a therapeutically effective amount of a domain antibody is 0.1-20 mg/kg, and in an aspect, 1-10 mg/kg, relative to the body weight of the patient. The dose of antibody polypeptide(s) can be further guided by the amount of antibody polypeptide(s) required for CD40 antagonism in in vitro and/or in vivo models of disease states. Representative models are described below and in the examples.

4. In Vitro and In Vivo Models

The ability of antibody polypeptides of the disclosure to antagonize CD40L can be tested in one of several available in vitro or in vivo model systems. Appropriate human, animal, and cell model systems are described below. Further cell assay systems are described in the examples.

4.1. Immune Thrombocytopenic Purpura (ITP) In Vivo Model:

The potential role of CD40-CD40L in the pathogenesis of ITP is reported by Patel et al., *British J. Haematology* 141: 545-548 (2008). Antiplatelet autoantibodies in patients with ITP bind to circulating platelets and accelerate their destruction. The primary mechanism by which anti-CD40L antibodies are thought to increase the platelet count in ITP is by blocking T-cell based activation of autoreactive B cells that produce anti-platelet antibodies. Anti-CD40L antibodies may also block expression of CD40L on platelets, thus preventing autopresentation of platelet glycoprotein antigens to macrophages. Furthermore, anti-CD40L mAbs inhibit direct interactions between platelet CD40L and other cells, such as plasmacytoid dendritic cells (DCs), which have recently been implicated in driving the type 1 interferon (IFN) response in human lupus patients. Duffau et al., *Sci. Transl. Med.* 2: 47 (2010).

Patel et al. demonstrated efficacy of two humanized anti-CD40L monoclonal antibodies, hu5c8 and IDEC-131, in 46 human patients with chronic ITP refractory to conventional therapies. The patients had an overall 24% response rate, characterized by increased platelet counts. This demonstrated the potential role of CD40-CD40L in the pathogenesis of ITP.

4.2. Lupus In Vivo and In Vitro Models:

Glomerular and tubular CD40 expression is markedly upregulated in proliferative nephritis. Several studies have reported hyperexpression of CD40L by T cells and elevated soluble sCD40L concentrations in human lupus. Kimura et al., *Therapeutic Apheriss and Dialysis* 9: 64-68 (2005); Vakkalanka et al., *Arthritis & Rheumatism* 42: 871-881 (1999).

Systemic lupus erythematosus (SLE) is a chronic autoimmune disease characterized by the production of multiple autoantibodies and by B cell hyperactivity. Grammer et al., *J. Clin. Invest.* 112: 1506-1520 (2003) reports the results of treatment of patients with SLE with humanized anti-CD40L mAb 5c8 (BG9588). See also Huang et al., *Arthritis & Reumatism* 46: 1554-1562 (2002). Grammer et al. report that CD19+ peripheral B cells were examined before and after treatment with the anti-CD40L mAb. Before treatment, SLE patients manifested activated B cells that expressed CD40L, CD69, CD38, CD5, and CD27. The activated B cells disappeared from the periphery during and post-treatment. Before treatment, active SLE patients had circulating $CD38^{bright}$ Ig-secreting cells that were not found in normal individuals. Disappearance of these plasma cells during treatment was associated with decreases in anti-double stranded DNA (anti-dsDNA) Ab levels, proteinuria, and SLE disease activity index. Consistent with this finding, peripheral B cells cultured in vitro spontaneously proliferated and secreted Ig in a manner that was inhibited by anti-CD40L mAb. The CD38+/++IgD+, CD38+++, and CD38+IgD−B cell subsets present in the peripheral blood of SLE patients also disappeared following treatment with the anti-CD40L mAb. Together, these results suggest that spontaneous CD40L-CD40 interactions in active SLE patients drive B cell activation, proliferation, and differentiation to autoantibody-secreting plasma cells that mediate proteinuria and disease activity.

Proliferative lupus glomerulonephritis is a protracted autoimmune disease with a waxing and waning course, characterized by increased level of anti-dsDNA antibodies, decreased serum C3 concentrations, and hematuria. Boumpas et al, *Arthritis & Rheumatism* 48: 719-727 (2003) report results of a phase II, multicenter, open-label study evaluating the toxicity and efficacy of BG9688, a humanized anti-CD40L monoclonal antibody, in patients with proliferative lupus glomerulonephritis. Although the study had to be terminated prematurely because of thromboembolic events occurring in patients in several BG9588 protocols, a short course of the anti-CD40L antibody treatment in patients with proliferative lupus nephritis reduced anti-dsDNA antibodies, increased C3 concentrations, and decreased hematuria, suggesting that the drug has immunomodulatory function.

4.3. Inflammatory Bowel Disease (IBD) In Vivo Models:

Crohn's disease (CD) and ulcerative colitis (UC) are IBDs that are characterized by leukocytic infiltrates in inflamed intestinal mucosa, which consists primarily of activated CD25+ cells, B cells, and macrophages. Ludwiczek et al., *Int. J. Colorectal Dis.* 18: 142-147 (2003) report that in CD patients, plasma levels of sCD40L were significantly higher than in healthy individuals. Moreover, CD patients with fistulas and/or abscesses had significantly higher levels of sCD40L than patients with uncomplicated CD. It has also been reported that the CD40-CD40L pathway contributes to the proinflammatory function of intestinal epithelial cells in IBD. Borcherding et al., *Am. J. Pathol.* 176: 1816-1827 (2010). Patients with CD also have an increased risk of systemic thromboembolism, and the hyperactive state of platelets from such patients likely results from the enhanced release of sCD40L as a consequence of their higher endogenous content of CD40L. Menchen et al., *Gut* 58: 920-928 (2009); see also Danese et al., *Gut* 52: 1435-1441 (2003).

Kasran et al., *Aliment. Pharmacol. Ther.* 22: 111-122 (2005) investigated the use of a chimeric anti-human CD40 mAb ch5D12 to treat Crohn's disease. The mAb was administered to 18 patients with moderate to severe CD in a single dose, open-label dose escalation phase I/IIa study. Of the 18 patients, 13 (or 72%) experienced a favorable response to the antibody infusion, and 4 patients (or 22%) experienced a remission. Treatment with the anti-CD40 mAb reduced microscopic disease activity and intensity of the lamina propria cell infiltrate, and the mAb was well tolerated.

4.4. Rheumatoid Arthritis (RA), Juvenile Idiopathic Arthritis (JIA), and Psoriatic Arthritis (PsA) In Vivo Models:

Rheumatoid arthritis is a systemic autoimmune disease with intra-articular inflammation as a dominant feature that affects up to 1% of the population. The disease can be subdivided clinically by the presence or absence of autoantibodies (antibodies to cyclic citrullinated peptide (CCP) or rheumatoid factor (RF), both of which are highly correlated to each other. Raychaudhuri et al., *Nature Genetics* 40: 1216-1223 (2008) reported that they conducted a meta-analysis of two published genome-wide association (GWA) studies totaling 3,393 cases and 12,462 controls, in order to identify RA risk loci in European populations. They genotyped 31 top-ranked short nucleotide polymorphisms (SNPs) not previously associated with RA in an independent replication of 3,929 autoantibody-positive RA cases and 5,807 matched controls from eight separate collections. They identified a common variant at the CD40 gene locus, which implied a central role for the CD40 signaling pathway in RA pathogenesis. The strong association of the CD40 gene with susceptibility to RA was robustly replicated in another study in a large UK cohort of 3,962 patients with RA. Orozso et al., *Ann. Rheum. Dis.* 69: 813-816 (2010).

A major role of CD40L has also been found in the pathogenesis of juvenile idiopathic arthritis (JIA). Prahalad et al., *Pediatric Rheumatology* 6: 1-8 (2008). JIA is a heterogeneous group of arthropathies of unknown etiology. It was found that sCD40L was significantly elevated in the serum of children with JIA, along with some cytokines. Logistic regression analysis suggested that sCD40L, as well as IL-6 and TNFα, were positively associated with JIA. sCD40L was elevated in all JIA subtypes, with highest levels among more severe subtypes. These results implicated sCD40L as a potential biomarker for treatment and monitoring of patients with JIA.

It has also been demonstrated that activated T cells from patients with psoriatic arthritis (PsA), and particularly those with active disease, have a significantly increased expression of CD40L. Daoussis et al., *Rheumatology* 46: 227-231 (2007). These results indicate a role of the CD40-CD40L pathway in the pathogenesis of PsA and that a therapy selectively targeting CD40L could benefit PsA patients.

4.5. Systemic Sclerosis In Vivo Models:

Systemic sclerosis (SSc) is an autoimmune connective tissue disorder characterized by fibrous and vascular changes in the skin and internal visceral organs. In a study involving 52 Japanese patients with SSc, serum sCD40L levels were elevated when compared with healthy controls. Komura et al., *J. Reumatol.* 31: 514-519 (2004). Moreover, levels of sCD40L in patients with SSc were higher than in patients with systemic lupus erythematosus (SLE) who had elevated sCD40L levels compared to controls, and sCD40L levels correlated positively with C reactive peptide levels in SSc patients. It has also been reported that blockade of CD40L with anti-CD40L antibody in cultured T and B cells from SSc patients inhibited anti-topoisomerase I antibody production. Kuwana et al., *J. Immunol.* 155: 2703-2714 (1995). These results suggest that inhibition of CD40-CD40L interactions may be potential therapeutic targets in therapy of SSc as well as SLE.

4.6. Atherosclerosis In Vivo Models:

Several studies have suggested a role of CD40-CD40L signaling pathway during atherogenesis. Mach et al. demonstrated that in mice, treatment with monoclonal anti-CD40L antibody limited atherosclerosis in mice lacking receptor for low-density lipoprotein that had been fed a high-cholesterol diet for 12 weeks. Nature 394: 200-203 (1998). The antibody reduced the size of aortic atherosclerotic lesions by 59% and their lipid content by 79%. Additionally, atheroma of mice treated with anti-CD40L antibody contained significantly fewer macrophages and T lymphocytes, and exhibited decreased expression of vascular cell adhesion molecule-1.

Anti-CD40L antibody treatment of low-density lipoprotein receptor-deficient mice during the second half of a 26-week regimen of a high-cholesterol diet did not regress, but did significantly reduce further progression of established atherosclerotic lesions within the aortic arch and particularly the thoracic and abdominal aorta, as compared to control treatment. Schonbeck et al., *Proc. Natl. Acad. Sci.* 97: 7458-7463 (2000). Furthermore, anti-CD40L treatment changed the composition of atheroma in manners thought to favor plaque stability, e.g., reduced relative content of macrophages and lipid, as well as increased relative content of smooth muscle cells and collagen. These studies lend support to the importance of the CD40-CD40L signaling pathway in atherosclerosis and its complications, such as coronary artery disease.

4.7. Allograft Rejection In Vivo Models:

Targeting the CD40-CD40L pathway has long been of much interest for prevention of rejection of solid organ transplants (SOT), particularly in light of the promising data from numerous published transplant studies in non-human primates. It has been demonstrated that reduced CD40L expression on ex vivo activated CD4+ T lymphocytes correlates with excellent renal allograft function. Lederer et al., *Int. Arch. Allergy Immunol.* 133: 276-284 (2004). Furthermore, several studies have demonstrated that anti-CD40L mAbs can both prevent and reverse acute allograft rejection in primates. For example, Kirk et al., *Proc. Natl. Acad. Sci. USA* 94: 8789-8794 (1997) reported that, in rhesus monkeys transplanted with renal allografts, anti-CD40L mAb 5C8 alone or in combination with CTLA4-Ig significantly prolonged rejection-free survival. The CD40L-specific mAb hu5c8 alone also allowed for allogeneic islet engraftment and long-term insulin independence in rhesus monkeys that were transplanted an adequate number of viable pancreatic islets. Kenyon et al., *Proc. Natl. Acad. Sci. USA* 96: 8132-8137 (1999). Preston et al., *Amer. J. Transplantation* 5: 1032-1041 (2005) performed renal transplants in MHC-mismatched rhesus monkeys and treated the recipients with combinations of CD40L-specific mAb IDEC-131, and/or sirolimus, and/or pre-transplant donor-specific transfusion. IDEC-131 was highly effective in preventing renal allograft rejection in primates. In cynomolgus monkeys that underwent renal allotransplantation, treatment with anti-CD40L mAb ABI793 effectively prevented graft rejection. Schuler et al., *Transplantation* 77: 717-726 (2004). In addition to preventing allograft rejection, CD40L-specific mAbs induced donor specific tolerance in primate transplant models. Preston et al., *Amer. J. Transplantation* 5: 1032-1041 (2005); Kenyon et al., *Proc. Natl. Acad. Sci. USA* 96: 8132-8137 (1999).

In pediatric human patients that were undergoing acute graft rejection after liver or small-bowel transplantation, a correlation was observed between the expression of CD40L on CD8+ T cells and the risk of transplant rejection. Ashokkumar et al., *Amer. J. Transplantation* 9: 179-191 (2009) and Ashokkumar et al., *Surgery* 146: 166-173 (2009). Similarly, in adult patients that were undergoing allograft rejection following liver or renal transplantation, histological analysis demonstrated an association between CD40L expression and acute or chronic rejection. Bartlett et al., *Amer. J. Transplantation* 3: 1363-1368 (2003) and Biancone et al., *Nephrol. Diall. Translpant.* 13: 716-722 (1998).

Several studies support targeting CD40L over CD40 to achieve better efficacy in transplantation. For example, graft survival is longer and more durable when CD40L is selectively blocked, compared to CD40. Gilson et al., *J. Immunol.* 183: 1625-35 (2009). Furthermore, recent data suggest that CD40L blockade may enhance induction of Tregs and/or suppressor cells to promote graft survival. Garcia et al., *J. Clin. Inv.* 120: 2486-96 (2010). Also, blockade of CD40L, but not CD40, has demonstrated induction of long-lived immunological tolerance resulting in indefinite graft survival, particularly when combined with blockade of the B7 pathway. Kenyon et al., *Proc. Natl. Acad. Sci. USA* 96: 8132-8137 (1999); Kawai et al., *Amer. J Transplantation* 4: 1391-1398 (2004); Preston et al., *Amer. J. Transplantation* 5: 1032-1041 (2005); Adams et al., *J. Immunol.* 174: 542-50 (2005). The synergy of blocking CD40-40L and B7-CD28 pathways in enhancing graft survival is especially important, because it presents the presently disclosed domain antibodies as a natural choice for combination with belatacept (CTLA4-Ig) for SOT.

4.8. Graft-Versus-Host Disease In Vivo Model:

Chronic and acute graft-versus-host disease (cGVHD and aGVHD) are complications that can occur after a stem cell or bone marrow transplant in which the transplanted donor cells attack the transplant recipient's body. Acute GVHD in humans takes place within about 60 days post-transplantation and results in damage to the skin, liver, and gut by the action of cytolytic lymphocytes. Chronic GVHD occurs later and is a systemic autoimmune disease that affects primarily the skin, resulting in the polyclonal activation of B cells and the hyperproduction of Ig and autoantibodies.

CD40L-CD40 interactions appear to be critical in the development of both cGVHD and aGVHD. Durie et al., *J. Clin. Invest.* 94: 1333-1338 (1994). In a mouse in vivo model, anti-CD40L antibodies blocked the following cGVHD-associated phenomena: splenomegaly, in vitro polyclonal Ig production, elevated levels of serum IgE and serum anti-DNA autoantibodies, and the generation of anti-host cytotoxic T cells. Antibody production remained inhibited for extended periods of time after the end of anti-CD40L antibody administration. In mice with aGVHD, which is associated with the induction of a profound antiallogenic cytotoxic T cell (CTL) response, treatment with anti-CD40L prevented the generation of H-2b-derived CTL. The results of the study suggest that CD40L-CD40 interactions are critical in GVHD and that CD40L may be a valuable ligand for targeting immunotherapeutic agents to control GVHD.

4.9. Myasthenia Gravis In Vivo Model:

Myasthenia gravis (MG) and its animal model, experimental autoimmune MG (EAMG), are T-cell dependent autoimmune disorders caused by autoantibodies against the nicotinic acetylcholine receptors (AChR) at the neuromuscular junction of skeletal muscle. The role of CD40-CD40L in EAMG was shown in CD40L (CD40L-/-) knockout mice. Shi et al, *Eur. J. Immunol.* 28: 3587-3593 (1998). The CD40L knockout mice were completely resistant to EAMG induction and had diminished Th1 and Th2 responses as well as severely impaired T-cell dependent AChR-reactive B cell responses.

It has also been demonstrated that blockade of CD40L-CD40 signaling by anti-CD40L antibodies is capable of suppressing EAMG. Im et al., *J. Immunol.* 166: 6893-6898 (2001). Antibodies given to rats at the chronic stage of EAMG suppress the clinical progression of the autoimmune response and lead to a decrease in the AChR-specific humoral response and delayed-type hypersensitivity. The effect of anti-CD40L treatment during the chronic phase of EAMG is of particular relevance to human MG, which is a chronic disease. It suggests that antagonizing CD40L can be used for immunotherapy of MG and other antibody-mediated autoimmune diseases.

5. Thromboembolism

CD40-CD40L interactions on T and antigen presenting cells are important for adaptive immune responses, such as B-cell proliferation, immunoglobulin (Ig) production, upregulation of co-stimulatory activity (CD80, CD86), cytokine production, and Ig class-switching. The receptor and ligand are also expressed on platelets (off-target cell population), where CD40 is constitutively found on platelets, while CD40L is expressed on activated platelets and cleaved to sCD40L (>90% of circulating sCD40L is derived from platelets). Feroni et al., *Curr. Med. Chem.* 14: 2170-2180 (2007). At least three anti-CD40L monoclonal antibodies (mAb) caused TE in the clinic and/or nonclinical studies conducted in non-human primates (NHP). hu5c8 (BG9588) caused TE in multiple clinical trials (lupus and renal transplantation). Boumpas et al., *Arthritis & Rheumatism* 48: 719-727 (2003). IDEC131 caused TE in one patient in a Crohn's disease trial, leading to termination of ongoing trials at the time. Sidiropoulus & Boumpas, *Lupus* 13: 391-397 (2004). Both hu5c8 and ABI1793 (which binds CD40 at a different epitope from 5c8) caused TE/thrombosis in renal transplantation studies in cynomolgus or rhesus monkeys. Schuler et al., *Transplantation* 77: 717-726 (2004); Kanmaz et al., *Transplantation* 77: 914-920 (2004); Koyama et al., *Transplantation* 77: 460-461 (2004). In a non-published disclosure, Biogen reported a thrombosis incidence of 1/4 and 6/12 in rhesus monkeys given 5 and 20 mg/kg weekly, respectively, for 6-months, but not in cynomolgus monkeys given 50 mg/kg at the same frequency and duration. The basis for the species difference is not clear.

Figure 10:
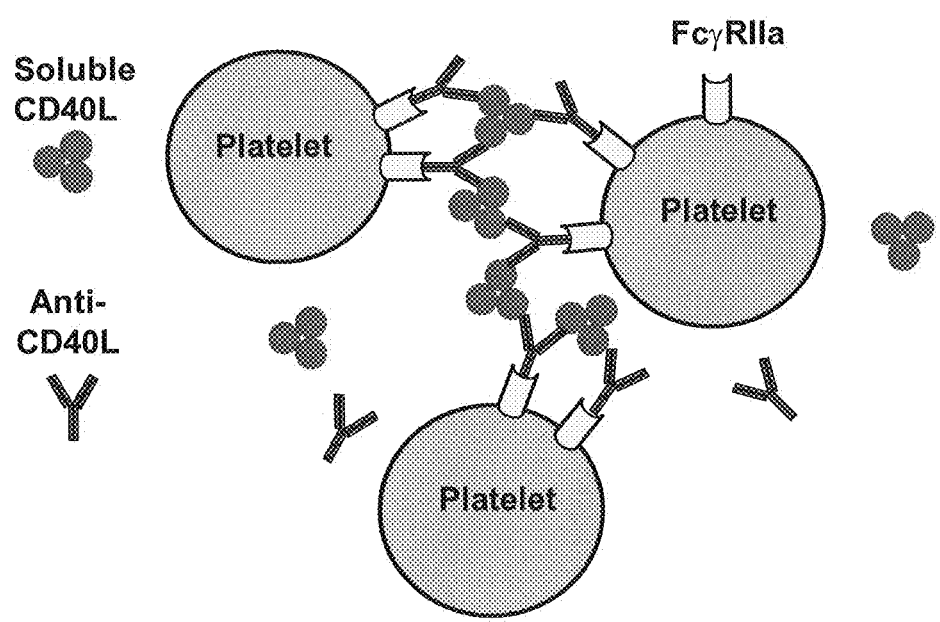
FIG. 10 provides a hypothetic model for anti-CD40 monoclonal antibody-mediated platelet aggregation.

One of the hypotheses is that the TE associated with administration of these antibodies is mediated by anti-CD40Lmab-CD40L immune complex (IC)-mediated cross linking of platelets, facilitated by IC binding to FcgRIIa, an IgG Fc receptor, causing activation and aggregation (FIG. 10). Blocking the interaction of Fc moiety of IgG with FcgRIIa is, therefore, expected to mitigate platelet cross linking and thrombosis. Approaches and methods developed to evaluate the risk for TE/thrombosis are described in Examples below.

EXAMPLES

TABLE 1 lists representative anti-human CD40L $V_H$ domain amino acid sequences useful for the disclosed antibody polypeptides. TABLE 2 discloses representative nucleic acids that encode the $V_H$ domain sequences listed in TABLE 1. TABLE 3 lists representative anti-human CD40L VK domain amino acid sequences useful for the antibody polypeptides of the present disclosure. TABLE 4 in turn discloses representative nucleic acids that encode the VK domain sequences listed in TABLE 3. As well known in the art, multiple codons can encode the same amino acid. Nucleic acids encoding a protein sequence thus include nucleic acids having codon degeneracy. The antibody polypeptides disclosed in TABLE 1 and TABLE 3 specifically bind CD40L. They were made using the reiterative initial/primary screening and affinity methodologies described in the examples that follow.

TABLE 1

Anti-human CD40L VH Domain Amino Acid Sequences

BMS2h-10 (SEQ ID NO: 15)
EVQLLESGGG LVQPGGSLRL SCAASGFTFI AYDMSWVRQA
PGKGLEWVSW IDEWGLQTYY ADSVKGRFTI SRDNSKNTLY
LQMNSLRAED TAVYYCAKKT PEE------- FDYWGQGTLV TVSS

BMS2h-11 (SEQ ID NO: 16)
EVQLLESGGG LVQPGGSLRL SCAASGFTFG DYEMSWVRQA
PGKGLEWVSG IDGEGSDTYY ADSVKGRFTI SRDNSKNTLY
LQMNSLRAED TAVYYCAKPG RS-------- FDYWGQGTLV TVSS

BMS2h-111 (SEQ ID NO: 17)
EVQLLESGGG LVQPGGSLRL SCAASGFTFE RYPMTWVRQA
PGKGLEWVST IHGSGSATYY ADSVKGRFTI SRDNSKNTLY
LQMNSLRAED TAVYYCAKGP YTSRHNSLGH FDYWGQGTLV TVSS

BMS2h-112 (SEQ ID NO: 18)
EVQLLESGGG LVQPGGSLRL SCAASGFTFM DYPMGWVRQA
PGKGLEWVSS IGPVGMSTYY ADSVKGRFTI SRDNSKNTLY
LQMNSLRAED TAVYYCAKYG GTSGRHNTK- FDYWGQGTLV TVSS

BMS2h-113 (SEQ ID NO: 19)
EVQLLESGGG LVQPGGSLRL SCAASGFTFT EYPMSWVRQA
PGKGLEWVSV ISPLGFTTYY ADSVKGRFTI SRDNSKNTLY
LQMNSLRAED TAVYYCAKWT GGGSGILNSS- FDYWGQGTLV TVSS

BMS2h-114 (SEQ ID NO: 20)
EVQLLESGGG LVQPGGSLRL SCAASGFRVS NYDLTWVRQA
PGKGLEWVST ISATNGSTYY ADSVKGRFTI SRDNSKNTLY
LQMNSLRAED TAVYYCAAVT WWLLRHNDN- LGFWGQGTLV TVSS

BMS2h-115 (SEQ ID NO: 21)
EVQLLESGGG LVQPGGSLRL SCAASGFSIS YKNMAWVRQA
PGKGLEWVSA IKAANGSTYY ADSVKGRFTI SRDNSKNTLY
LQMNSLRAED TAVYYCATGS QKKRTYT--- FDFWGQGTLV TVSS

TABLE 1-continued

Anti-human CD40L VH Domain Amino Acid Sequences

BMS2h-12 (SEQ ID NO: 22)
EVQLLESGGG LVQPGGSLRL SCAASGFTFR LYEMAWVRQA
PGKGLEWVSG IDILGSRTYY ADSVKGRFTI SRDNSKNTLY
LQMNSLRAED TAVYYCAKDL SWQG------ FDYWGQGTLV TVSS

BMS2h-120 (SEQ ID NO: 23)
EVQLLESGGG LVQPGGSLRL SCAASGFTFR SYTMGWVRQA
PGKGLEWVSS INPMGYQTYY ADSVKGRFTI SRDNSKNTLY
LQMNSLRAED TAVYYCAKHG VGKGTKPHN FDYWGQGTLV TVSS

BMS2h-121 (SEQ ID NO: 24)
EVQLLESGGG LVQPGGSLRL SCAASGFTFE LYRMSWVRQA
PGKGLEWVSE ISGSGFPTYY ADSVKGRFTI SRDNSKNTLY
LQMNSLRAED TAVYYCAKSL HDKTQHHQE FDYWGQGTLV TVSS

BMS2h-123 (SEQ ID NO: 25)
EVQLLESGGG LVQPGGSLRL SCAASGFTFI EYPMRWVRQA
PGKGLEWVSL ISPSGVFTYY ADSVKGRFTI SRDNSKNTLY
LQMNSLRAED TAVYYCAKGD ESST FDYWGQGTLV TVSS

BMS2h-124 (SEQ ID NO: 26)
EVQLLESGGG LVQPGGSLRL SCAASGFTFK RYDMDWVRQA
PGKGLEWVST IGSSGYPTYY ADSVKGRFTI SRDNSKNTLY
LQMNSLRAED TAVYYCAERM PGYFPGFARQ FDYWGQGTLV TVSS

BMS2h-125 (SEQ ID NO: 27)
EVQLLESGGG LVQPGGSLRL SCAASGFTFW RYAMGWVRQA
PGKGLEWVST INDEGRETYY ADSVKGRFTI SRDNSKNTLY
LQMNSLRAED TAVYYCAKKR VSSSVNAPYE FDYWGQGTLV TVSS

BMS2h-126 (SEQ ID NO: 28)
EVQLLESGGG LVQPGGSLRL SCAASGFTFA NYSMSWVRQA
PGKGLEWVSS IDRLGTHTYY ADSVKGRFTI SRDNSKNTLY
LQMNSLRAED TAVYYCAKVL ADLIAGHAE FDYWGQGTLV TVSS

BMS2h-127 (SEQ ID NO: 29)
EVQLLESGGG LVQPGGSLRL SCAASGFTFP SYDMAWVRQA
PGKGLEWVSG ISRSGSMTYY ADSVKGRFTI SRDNSKNTLY
LQMNSLRAED TAVYYCAKGV DAHVYYMEPF FDYWGQGTLV TVSS

BMS2h-128 (SEQ ID NO: 30)
EVQLLESGGG LVQPGGSLRL SCAASGFTFE RYQMAWVRQA
PGKGLEWVST ISSDGGGTYY ADSVKGRFTI SRDNSKNTLY
LQMNSLRAED TAVYYCAKPG TV FDYWGQGTLV TVSS

BMS2h-129 (SEQ ID NO: 31)
EVQLLESGGG LVQPGGSLRL SCAASGFTFP KYEMAWVRQA
PGKGLEWVSS IDGDGKSTYY ADSVKGRFTI SRDNSKNTLY
LQMNSLRAED TAVYYCAKPD QF FDYWGQGTLV TVSS

BMS2h-13 (SEQ ID NO: 32)
EVQLLESGGG LVQPGGSLRL SCAASGFTFS YYSMYWVRQA
PGKGLEWVSS ISPFGWGTYY ADSVKGRFTI SRDNSKDTLY
LQMNSLRAED TAVYYCAKYG ETSGPISEN FDYWGQGTLV TVSS

BMS2h-130 (SEQ ID NO: 33)
EVQLLESGGG LVQPGGSLRL SCTASGFTFA GYQMSWVRQA
PGKGLEWVSS ITNEGVSTYY ADSVKGRFTI SRDNSKNTLY
LQMNSLRAED TAVYYCAKPG KY FDYWGQGTLV TVSS

BMS2h-131 (SEQ ID NO: 34)
EVQLLESGGG LVQPGGSLRL SCAASGFTFG EYEMVWVRQA
PGKGLEWVSS ITSDGLSTYY ADSVKGRFTI SRDNSKNTLY
LQMNSLRAED TAVYYCAKPG IRFDYWGQGTLV TVSS

BMS2h-132 (SEQ ID NO: 35)
EVQLLESGGG LVQPGGSLRL SCAASGFTFA DYDMAWVRQA
PGKGLEWVSG IVDDGLMTYY ADSVKGRFTI SRDNSKNTLY
LQMNSLRAED TAVYYCAKPD VAFDYWGQGTLVTVSN

BMS2h-133 (SEQ ID NO: 36)
EVQLLESGGG LVQPGGSLRL SCAASGFTFG GYAMAWVRQA
PGKGLEWVSS IGPLGATTYY ADSVKGRFTI SRDNSKNTLY
LQMNSLRAED TAVYYCAKLP AGTSSHSVDFDYWGQGTLV TVSS

TABLE 1-continued

Anti-human CD40L VH Domain Amino Acid Sequences

BMS2h-134 (SEQ ID NO: 37)
EVQLLESGGG LVQPGGSLRL SCAASGFTFA DYEMTWVRQA
PGKGLEWVSS ITSDGVSTYY ADSVKGRFTI SRDNSKNTLY
LQMNSLRAED TAVYYCAKPS VQ FDYWGQGTLV TVSS

BMS2h-135 (SEQ ID NO: 38)
EVQLLESGGG LVQPGGSLRL SCAASGFTFR RYVMGWVRQA
PGKGLEWVSW IEADGRTTYY ADSVKGRFTI SRDNSKNTLY
LQMNSLRAED TAVYYCAKGL TDQHVIE FDYWGQGTLV TVSS

BMS2h-136 (SEQ ID NO: 39)
EVQLLESGGG LVQPGGSLRL SCAASGFTFD GYRMGWVRQA
PGKGLEWVSS IAPDGNYTYY ADSVKGRFTI SRDNSKNTLY
LQMNSLRAED TAVYYCAKFW GMQFDYWGQGTLV TVSS

BMS2h-137 (SEQ ID NO: 40)
EVQLLESGGG LVQPGGSLRL SCAASGFTFA SYPMGWVRQA
PGKGLEWVSS IGPIGFTTYY ADSVKGRFTI SRDNSKNTLY
LQMNSLRAED TAVYYCAEMK SPYKPQ---- FDYWGQGTLV TVSS

BMS2h-138 (SEQ ID NO: 41)
EVQLLESGGG LVQPGGSLRL SCAASGFTFL AYWMWVRQA
PGKGLEWVSS ISPSGTHTYY ADSVKGRFTI SRDNSKNTLY
LQMNSLRVED TAVYYCAKYT EPGLGS---- FDYWGQGTLV TVSS

BMS2h-139 (SEQ ID NO: 42)
EVQLLESGGG LVQPGGSLRL SCAASGFTFS NYEMGWVRQA
PGKGLEWVSV ISEVGSLTYY ADSVKGRFTI SRDNSKNTLY
LQMNSLRAED TAVYYCAKPH DSSIG----- FDYWGQGTLV TVSS

BMS2h-14 (SEQ ID NO: 43)
EVQLLESGGG LVQPGGSLRL SCAASGFTFW SYDMTWVRQA
PGKGLEWVSS IMASGDDTYY ADSVKGRFTI SRDNSKNTLY
LQMNSLRAED TAVYYCAKWD RD-------- FDYWGQGTLV TVSS

BMS2h-15 (SEQ ID NO: 44)
EVQLLESGGG LVQPGGSLRL SCAASGFTFE EYVMSWVRQA
PGKGLEWVST ISPIGLTTYY ADSVKGRFTI SRDNSKNTLY
LQMNSLRAED TAVYYCAEFP LIILPD---- FDYWGQGTLV TVSS

BMS2h-16 (SEQ ID NO: 45)
EVQLLESGGG LVQPGGSLRL SCAASGFTFM EYAMIWVRQA
PGKGLEWVSI ISPLGLSTYY ADSVKGRFTI SRDNSKNTLY
LQMNSLRAED TAVYYCAKYQ DSSDSQYTN- FDYWGQGTLV TVSS

BMS2h-17 (SEQ ID NO: 46)
EVQLLESGGG LVQPGGSLRL SCAASGFTFE DYGMGWARQA
PGKGLEWVSS IGPLGLWTYY ADSAKGRFTI SRDNSKNTLY
LQMNSLRAED TAVYYCAKSP LEGLITN--- FDYWGQGTLV TVSS

BMS2h-176 (SEQ ID NO: 47)
EVQLLESGGG LVQPGGSLRL SCAASGFTFD AYEMGWVRQA
PGKGLEWVSI IDWDGNSTYY ADSVKGRFTI SRDNSKNTLY
LQMNSLRAED TAVYYCAKPG DNVGI----- FDYWGQGTLV TVSS

BMS2h-177 (SEQ ID NO: 48)
EVQLLESGGG LVQPGGSLRL SCAASGFTFS NYYMVWVRQA
PGKGLEWVSA IDEWGPATYY ADSVKGRFTI SRDNSKNTLY
LQMNSLRAED TAVYYCAKHW EFTSDTSR-FDYWGQGTLV TVSS

BMS2h-178 (SEQ ID NO: 49)
EVQLLESGGG LVQPGGSLRL SCAASGFTFE DFDMAWVRQA
PGKGLEWVSS INDQGSLTYY ADSVKGRFTI SRDNSKNTLY
LQMNSLRAED TAVYYCAKPD QF-------- FDYWGQGTLV TVSS

BMS2h-179 (SEQ ID NO: 50)
EVQLLESGGG LVQPGGSLRL SCAASGFTFS AYDMMWVRQA
PGKGLEWVSR ISPQGQRTYY ADSVKGRFTI SRDNSKNTLY
LQMNSLRAED TAVYYCAKIR GQSRIPMR-FDYWGQGTLV TVSS

BMS2h-18 (SEQ ID NO: 51)
EVQLLESGGG LVQPGGSLRL SCAASGFTFP EYDMTWVRQA
PGKGLEWVSY ISSDGYSTYY ADSVKGRFTI SRDNSKNTLY
LQMNSLRAED TAVYYCAKPH GSPRE----- FDYWGQGTLV TVSS

BMS2h-180 (SEQ ID NO: 52)
EVQLLESGGG LVQPGGSLRL SCAASGFTFT DYEMGWVRQA
PGKGLEWVST ITSLGESTYY ADSVKGRFTI SRDNSKNTLY
LQMNSLRAED TAVYYCAKPG RI-------- FDYWGQGTLV TVSS

BMS2h-181 (SEQ ID NO: 53)
EVQLLESGGG LVQPGGSLRL SCAASGFTFA FYPMMWVRQA
PGKGLEWVSW IDATGTRTYY ADSVKGRFTI SRDNSKNTLY
LQMNSLRAED TAVYYCAEGN YGSSYTMGV- FDYWGQGTLV TVSS

BMS2h-182 (SEQ ID NO: 54)
EVQLLESGGG LVQPGGSLRL SCAASGFTFD EYPMYWVRQA
PGKGLEWVSS IGPSGPNTYY ADSVKGRFTI SRDNSKNTLY
LQMNSLRAED TAVYYCAKSP YFDVIPSY-FDYWGQGTLV TVSS

BMS2h-183 (SEQ ID NO: 55)
EVQLLESGGG LVQPGGSLRL SCAASGFTFA DYGMGWVRQA
PGKGLEWVSS IQSSGLRTYY ADSVKGRFTI SRDNSKNTLY
LQMNSLRAED TAVYYCAKRA NSRRG----- FDYWGQGTLV TVSS

BMS2h-184 (SEQ ID NO: 56)
EVQLLESGGG LVQPGGSLRL SCAASGFTFS DYEMMWVRQA
PGKGLEWVSS ITSHGGSTYY ADSVKGRFTI SRDNSKNTLY
LQMNSLRAED TAVYYCAKPD KD-------- FDYWGQGTLV TVSS

BMS2h-185 (SEQ ID NO: 57)
EVQLLESGGG LVQPGGSLRL SCAASGFTFA HYPMSWVRQA
PGKGLEWVSS IGRLGNRTYY ADSVKGRFTI SRDNSKNTLY
LQMNSLRAED TAVYYCAKRA TPVPIKGL-FDYWGQGTLV TVSS

BMS2h-186 (SEQ ID NO: 58)
EVQLLESGGG LVQPGGSLRL SCAASGLTFG RYEMAWVRQA
PGKGLEWVSS IDSDGWVTYY ADSVKGRFTI SRDNSKNTLY
LQMNSLRAED TAVYYCAQPD SL-------- FDYWGQGTLV TVSS

BMS2h-187 (SEQ ID NO: 59)
EVQLLESGGG LVQPGGSLRL SCAASGFTFS SYSMVWVRQA
PGKGLEWVSG INRGGTRTYY ADSVKGRFTI SRDNSKNTLY
LQMNSLRAED TAVYYCAKGW RRG------- FDYWGQGTLV TVSS

BMS2h-188 (SEQ ID NO: 60)
EVQLLESGGG LVQPGGSLRL SCAASGFTFT RYRMSWVRQA
PGKGLEWVSG ISRDGYRTYY ADSVKGRFTI SRDNSKNTLY
LQMNSLRAED TAVYYCAKGM TAS------- FDYWGQGTLV TVSS

BMS2h-189 (SEQ ID NO: 61)
EVQLLESGGG LVQPGGSLRL SCAASGFTFQ MYPMGWVRQA
PGKGLEWVSM IEPAGDLTYY ADSVKGRFTI SRDNSKNTLY
LQMNSLRAED TAVYYCAKYQ EQPW------ FDYWGQGTLV TVSS

BMS2h-19 (SEQ ID NO: 62)
EVQLLESGGG LVQPGGSLRL SCAASGFPFP QYQMAWVRQA
PGKGLEWVSM ITSDGLDTYY ADSVKGRFTI SRDNSKNTLY
LQMNSLRAED TAVYYCAKPE PL-------- FDYWGQGTLV TVSS

BMS2h-190 (SEQ ID NO: 63)
EVQLLESGGG LVQPGGSLRL SCAASGFTFS MYDMHWVRQA
PGKGLEWVST ILSDGTDTYY ADSVKGRFTI SRDNSKNTLY
LQMNSLRAED TAVYYCAKYG AM-------- FDYWGQGTLV TVSS

BMS2h-191 (SEQ ID NO: 64)
EVQLLESGGG LVQPGGSLRL SCAASGFTFK LYPMTWVRQA
PGKGLEWVSS IDAGGHETYY ADSVKGRFTI SRDNSKNTLY
LQMNSLRAED TAVYYCAKDW WDYL------ FDYWGQGTLV TVSS

BMS2h-192 (SEQ ID NO: 65)
EVQLLESGGG LVQPGGSLRL SCAASGFTFS RYPMSWVRQA
PGKGLEWVSS INRSGMRTYY ADSVKGRFTI SRDNSKNTLY
LQMNSLRAED TAVYYCAEGH QAP------- FDYWGQGTLV TVSS

BMS2h-193 (SEQ ID NO: 66)
EVQLLESGGG LVQPGGSLRL SCAASGFTFT GYAMSWVRQA
PGKGLEWVST INANGIRTYY ADSVKGRFTI SRDNSKNTLY
LQMNGLRAED TAVYYCAKGG VWRWGTGHK- FDYWGQGTLV TVSS

BMS2h-194 (SEQ ID NO: 67)
EVQLLESGGG LVQPGGSLRL SCAASGFTFK QYDMRWVRQA

TABLE 1-continued

Anti-human CD40L VH Domain Amino Acid Sequences

PGKGLEWVST ISQNGTKTYY ADSVKGRFTI SRDNSKNTLY
LQMNSLRAED TAVYYCAKSR TGRY------ FDYWGQGTLV TVSS

BMS2h-195 (SEQ ID NO: 68)
EVQLLESGGG LVQPGGSLRL SCAASGFTFG TYDMGWVRQA
PGKGLEWVSR INWQGDRTYY ADSVKGRFTI SRDNSKNTLY
LQMNSLRAED TAVYYCAKAG FGHYVDGLG- FDYWGQGTLV TVSS

BMS2h-196 (SEQ ID NO: 69)
EVQLLESGGG LVQPGGSLRL SCAASGFTFS GYEMAWVRQA
PGKGLEWVSS ITDMGDSTYY ADSVKGRFTI SRDNSKNTLY
LQMNSLRAED TAVYYCAKPG TA-------- FDYWGPGTLV TVSS

BMS2h-197 (SEQ ID NO: 70)
EVQLLESGGG LVQPGGSLRL SCAASGFTFA KYKMWVRQA
PGKGLEWVSS ITPKGHSTYY ADSVKGRFTI SRDNSKNTLY
LQMNSLRAED TAVYYCAKRP MTP------- FDYWGQGTLV TVSS

BMS2h-198 (SEQ ID NO: 71)
EVQLLESGGG LVQPGGSLRL SCAASGFTFE RYNMSWVRQA
PGKGLEWVSS IRPGGKTYY ADSVKGRFTI SRDNSKNTLY
LQMNSLRAED TAVYYCAKWR REGYTGSK-FDYWGQGTLV TVSS

BMS2h-199 (SEQ ID NO: 72)
EVQLLESGGG LVQPGGSLRL SCAASGFTFE RYGMTWVRQA
PGKGLEWVSS IWPRGQKTYY ADSVKGRFTI SRDNSKNTLY
LQMNSLRAED TAVYYCAKGN SRYV------ FDYWGQGTLV TVSS

BMS2h-2 (SEQ ID NO: 73)
EVQLLESGGG LVQPGGSLRL SCAASGFTFS DYEMMWVRQA
PGKGLEWVST ITSDGISTYY ADSVKGRFTI FRDNSKNTLY
LQMNSLRAED TAVYYCAKSG RF-------- FDYWGQGTLV TVSS

BMS2h-20 (SEQ ID NO: 74)
EVQLLESGGG LVQPGGSLRL SCAASGFTFS GYQMAWVRQA
PGKGLEWVSG ISSEGLTTYY ADSVKGRFTI SRDNSKNTLY
LQMNSLRAED TAVYYCAKLG RR-------- FDYWGQGTLV TVSS

BMS2h-200 (SEQ ID NO: 75)
EVQLLESGGG LVQPGGSLRL SCAASGFTFT NYSMGWVRQA
PGKGLEWVST IRPNGTKTYY ADSVKGRFTI SRDNSKNTLY
LQMNSLRAED TAVYYCAKRS SAHLQR---- FDYWGQGTLV TVSS

BMS2h-201 (SEQ ID NO: 76)
EVQLLESGGG LVQPGGSLRL SCAASGFTFG NYSMGWVRQA
PGKGLEWVSS IGRHGGRTYY ADSVKGRFTI SRDNSKNTLY
LQMNSLRAED TAVYYCAKKG STYPR----- FDYWGQGTLV TVSS

BMS2h-202 (SEQ ID NO: 77)
EVQLLESGGG LVQPGGSLRL SCTASGFTFS HYEMGWVRQA
PGKGLEWVSS IEPFGGGTYY ADSVKGRFTI SRDNSKNTLY
LQMNSLRAED TAVYYCAKVY PQGS------ FDYWGQGTLV TVSS

BMS2h-203 (SEQ ID NO: 78)
EVQLLESGGG LVQPGGSLRL SCAASGFTFS NYTMGWVRQA
PGKGLEWVSS IRPDGKITYY ADSVKGRFTI SRDNSKNTLY
LQMNSLRAED TAVYYCAEVY SSCAMCTPLL FDYWGQGTLV TVSS

BMS2h-204 (SEQ ID NO: 79)
EVQLLESGGG LVQPGGSLRL SCAASGFTFK RYSMAWVRQA
PGKGLEWVSD IGPRGFSTYY ADSVKGRFTI SRDNSKNTLY
LQMNSLRAED TAVYYCAKVG RGQRDTSQP- FDYWGQGTLV TVSS

BMS2h-205 (SEQ ID NO: 80)
EVQLLESGGG LVQPGGSLRL SCAASGFTFA SYQMAWVRQA
PGKGLEWVSG ITSGGLSTYY ADSVKGRFTI SRDNSKNTLY
LQMNSLRAED TAVYYCAKPG RG-------- FDYWGQGTLV TVSS

BMS2h-206 (SEQ ID NO: 81)
EVQLLESGGG LVQPGGSLRL SCAASGFTFA SYEMTWVRQA
PGKGLEWVSG ISSDGLSTYY ADSVKGRFTI SRDNSKNTLY
LQMNSLRAED TAVYYCAKPG VL-------- FDYWGQGTLV TVSS

BMS2h-207 (SEQ ID NO: 82)
EVQLLESGGG LVQPGGSLRL SCAASGFTFD KYLMSWVRQA
PGKGLEWVSG IEPLGDVTYY ADSVKGRFTI SRDNSKNTLY
LQMNSLRAED TAVYYCAKEA SGD------- FDYWGQGTLV TVSS

TABLE 1-continued

Anti-human CD40L VH Domain Amino Acid Sequences

BMS2h-208 (SEQ ID NO: 83)
EVQLLESGGG LVQPGGSLRL SCAASGFTFT EYEMSWVRQA
PGKGLEWVSS IDNVGSSTYY ADSVKGRFTI SRDNSKNTLY
LQMNSLRAED TAVYYCAKPG KL-------- FDYWGQGTLV TVSS

BMS2h-209 (SEQ ID NO: 84)
EVQLLESGGG LVQPGGSLRL SCAASGFTFA DYEMWWVRQA
PGKGLEWVSA ISRQGFATYY ADSVKGRFTI SRDNSKNTLY
LQMNSLRAED TAVYYCAKDL ERDD------ FDYWGQGTLV TVSS

BMS2h-21 (SEQ ID NO: 85)
EVQLLESGGG LVQPGGSLRL SCAASGFTFA NYEMGWARQA
PGKGLEWVSV ISEWGYSTYY ADSAKGRFTI SRDNSKNTLY
LQMNSLRAED TAVYYCAKLV GGTQYE---- FDYWGQGTLV TVSS

BMS2h-22 (SEQ ID NO: 86)
EVQLLESGGG LVQPGGSLRL SCAASGFTFH NYEMSWVRQA
PGKGLEWVSS ISSGGSSTYY ADSVKGRFTI SRDNSKNTLY
LQMNSLRAED TAVYYCAKPG VK-------- FDYWGQGTLV TVSS

BMS2h-23 (SEQ ID NO: 87)
EVQLLESGGG LVQPGGSLRL SCAASGFTFG LYEMTWVRQA
PGKGLEWVSS ITGDGISTYY ADSVKGRFTI SRDNSRNTLY
LQMNSLRAED TAVYYCAKAG RK-------- FDYWGQGTLV TVSS

BMS2h-24 (SEQ ID NO: 88)
EVQLLESGGG LVQPGGSLRL SCAASGFTFS NYQMAWVRQA
PGKGLEWVSS ITSEGGSTYY ADSVKGRFTI SRDNSKNTLY
LQMNSLRAED TAVYYCAKPG KN-------- FDYWGQGTLV TVSS

BMS2h-24-1 (SEQ ID NO: 89)
EVQLLESGGG LVQPGGSLRL SCAASGFTFS DYQMAWVRQA
PGKGLEWVSS ITSEGGSTYY ADSVKGRFTI SRDNSKNTVY
LQMNSLRAED TAVYYCAKPG KN-------- FDYWGQGTLV TVSS

BMS2h-25 (SEQ ID NO: 90)
EVQLLESGGG LVQPGGSLRL SCAASGFTFD NYEMTWVRQA
PGKGLEWVST ITSQGTSTYY ADSVKGRFTI SRDNSKNTLY
LQMNSLRAED TAVYYCAKPD RS-------- FDYWGQGTLV TVSS

BMS2h-26 (SEQ ID NO: 91)
EVQLLESGGG LVQPGGSLRL SCAASGFTFR SYEMTWVRQA
PGKGLEWVSS ITSDGGTTYY ADSVKGRFTI SRDNSKNTLY
LQMNSLRAED TAVYYCAKPD KT-------- FDYWGQGTLV TVSS

BMS2h-27 (SEQ ID NO: 92)
EVQLLESGGG LVQPGGSLRL SCAASGFTFN LYEMTWVRQA
PGKGLEWVSS ITSDGVSTYY ADSVKGRFTI SRDNSKNTLY
LQMNSLRAED TAVYYCAKPD SP-------- FDYWGQGTLV TVSS

BMS2h-28 (SEQ ID NO: 93)
EVQLLESGGG LVQPGGSLRL SCAASGFTFH HYDMAWVRQA
PGKGLEWVST ISDNGNGTYY ADSVKGRFTI SRDNSKNTLY
LQMNSLRAED TAVYYCAKPG RD-------- FDYWGQGTLV TVSS

BMS2h-29 (SEQ ID NO: 94)
EVQLLESGGG LVQPGGSLRL SCAASGFTFG RYQMAWVRQA
PGKGLEWVSS ISSDGGGTYY ADSVKGRFTI SRDNSKNTLY
LQMNSLRAED TAVYYCAKPG RA-------- FDYWGQGTLV TVSS

BMS2h-30 (SEQ ID NO: 95)
EVQLLESGGG LVQPGGSLRL SCAASGFTFA RYQMAWVRQA
PGKGLEWVST ISDDGDSTYY ADSVKGRFTI SRDNSKNTLY
LQMNSLRAED TAVYYCAKLD KL-------- FDYWGQGTLV TVSS

BMS2h-300 (SEQ ID NO: 96)
EVQLLESGGG LVQPGGSLRL SCAASGFTFD NDEMTWVRQA
PGKGLEWVSA IDTTGGQTYY ADSVKGRFTI SRDNSKNTLY
LQMNSLRAED TAVYYCAKPG KE-------- FDYWGQGTLV TVSS

BMS2h-301 (SEQ ID NO: 97)
EVQLLESGGG LVQPGGSLRL SCAASGFTFG ESEMSWVRQA
PGKGLEWVSS ILDEGSGTYY ADSVKGRFTI SRDNSKNTLY
LQMNSLRAED TAVYYCAKPD KD-------- FDYWGQGTLV TVSS

TABLE 1-continued

Anti-human CD40L VH Domain Amino Acid Sequences

BMS2h-302 (SEQ ID NO: 98)
EVQLLESGGG LVQPGGSLRL SCAASGFTFG EEEMSWVRQA
PGKGLEWVSA ITDDGDDTYY ADSVKGRFTI SRDNSKNTLY
LQMNSLRAED TAVYYCAKPN AGA------- FDYWGQGTLV TVSS

BMS2h-303 (SEQ ID NO: 99)
EVQLLESGGG LVQPGGSLRL SCAASGFTFE VYDMAWVRQA
PGKGLEWVSG IVNDGSSTYY ADSVKGRFTI SRDNSKNTLY
LQMNSLRAED TAVYYCAKPD KD-------- FDYWGQGTLV TVSS

BMS2h-304 (SEQ ID NO: 100)
EVQLLESGGG LVQPGGSLRL SCAASGFTFG NTEMTWVRQA
PGKGLEWVSS IADDGSSTYY ADSVKGRFTI SRDNSKNTLY
LQMNSLRAED TAVYYCAKPG QA-------- FDYWGQGTLV TVSS

BMS2h-31 (SEQ ID NO: 101)
EVQLLESGGG LVQPGGSLRL SCAASGFTFE EYQMAWVRQA
PGKGLEWVST ISDDGSSTYY ADSVKGRFTI SRDNSKNTLY
LQMNSLRAED TAVYYCAKPD LY-------- FDYWGQGTLV TVSS

BMS2h-32 (SEQ ID NO: 102)
EVQLLESGGG LVQPGGSLRL SCAASGFTFE VYQMGWVRQA
PGKGLEWVSF IVPGGDLTYY ADSVKGRFTI SRDNSKNTLY
LQMNSLRAED TAVYYCAETW PE-------- FDYWGQGTLV TVSS

BMS2h-4 (SEQ ID NO: 103)
EVQLLESGGG LVQPGGSLRL SCAASGFTFD NYEMTWVRQA
PGKGLEWVSS ITSDGTSTYY ADSVKGRFTI SRDNSKNTLY
LQMNSLRAED TAVYYCAKPN PP-------- FDYWGQGTLV TVSS

BMS2h-40 (SEQ ID NO: 104)
EVQLLESGGG LVQPGGSLRL SCAASGFTFK AYDMGWVRQA
PGKGLEWVSQ IGRDGSFTYY ADSVKGRFTI SRDNSKNTLY
LQMNSLRAED TAVYYCAKPR RYAIF----- TFDRGQGTLV TVSS

BMS2h-400 (SEQ ID NO: 105)
EVQLLESGGG LVQPGGSLRL SCAASGFTFK QYPMVWVRQA
PGKGLEWVST ISTNGVRTYY ADSVKGRFTI SRDNSKNTLY
LQMNSLRAED TAVYYCAKWT DIISSSE--- FDYWGQGTLV TVSS

BMS2h-401 (SEQ ID NO: 106)
EVQLLESGGG LVQPGGSLRL SCAASGFTFF NYDMSWVRQA
PGKGLEWVSA ISGSGGSTYY ADSVKGRFTI SRDNSKNTLY
LQMNSLRAED TAVYYCAKVF VWSADIDFD- FDYWGQGTLV TVSS

BMS2h-402 (SEQ ID NO: 107)
EVQLLESGGG LVQPGGSLRL SCAASGFTFS WYDMSWVRQA
PGKGLEWVSH IASWGGKTYY ADSVKGRFTI SRDNSKNTLY
LQMNSLRAED TAVYYCAKVT VKDGGYLMD- FDYWGQGTLV TVSS

BMS2h-403 (SEQ ID NO: 108)
EVQLLESGGG LVQPGGSLRL SCAASGFTFA EYAMAWVRQA
PGKGLEWVSS IGRDGAVTYY ADSVKGRFTI SRDNSKNTLY
LQMNSLRAED TAVYYCAKWK AAKERGSW-FDYWGQGTLV TVSS

BMS2h-404 (SEQ ID NO: 109)
EVQLLESGGG LVQPGGSLRL SCAASGFTFQ AYQMQWVRQA
PGKGLEWVST ISPNGLFTYY ADSVKGRFTI SRDNSKNTLY
LQMNSLRAED TAVYYCAKWL SS-------- FDYWGQGTLV TVSS

BMS2h-407 (SEQ ID NO: 110)
EVQLLESGGG LVQPGGSLRL SCAASGFTFA MYSMAWVRQA
PGKGLEWVSG ISPRGVETYY ADSVKGRFTI SRDNSKNTLY
LQMNSLRAED TAVYYCAKTN WNGVDL---- FDYWGQGTLV TVSS

BMS2h-408 (SEQ ID NO: 111)
EVQLLESGGG LVQPGGSLRL SCAASGFTFP TYMMSWVRQA
PGKGLEWVST INTNGRDTYY ADSVKGRFTI SRDNSKNTLY
LQMNSLRAED TAVYYCAKGD SNMSF----- FDYWGQGTLV TVSS

BMS2h-409 (SEQ ID NO: 112)
EVQLLESGGG LVQPGGSLRL SCAASGFTFE GYSMTWVRQA
PGKGLEWVSS INASGTLTYY ADSVKGRFTI SRDNSKNTLY
LQMNSLRAED TAVYYCAKDG NRSEVF---- FDYWGQGTLV TVSS

BMS2h-41 (SEQ ID NO: 113)
EVQLLESGGG LVQPGGSLRL SCAASGFTFF EYEMTWVRQA
PGKGLEWVSS IANDGSTTYY ADSVKGRFTI SRDNSKNTLY
LQMNSLRAED TAVYYCAKPD RQ-------- FDYWGQGTLV TVSS

BMS2h-410 (SEQ ID NO: 114)
EVQLLESGGG LVQPGGSLRL SCAASGFTFQ DYLMAWVRQA
PGKGLEWVSE INQDGTVTYY ADSVKGRFTI SRDNSKNTLY
LQMNSLRAED TAVYYCAESS PY-------- FDYWGQGTLV TVSS

BMS2h-411 (SEQ ID NO: 115)
EVQLLESGGG LVQPGGSLRL SCAASGFTFD NYAMSWVRQA
PGKGLEWVSI ISRDGHVTYY ADSVKGRFTI SRDNSKNTLY
LQMNSLRAED TAVYYCAKLS SKGGTFASS- FDYWGQGTLV TVSS

BMS2h-412 (SEQ ID NO: 116)
EVQLLESGGG LVQPGGSLRL SCAASGFTFS AVPMTWVRQA
PGKGLEWVSA ITDDGLRTYY ADSVKGRFTI SRDNSKNTLY
LQMNSLRAED TAVYYCAKGH IYGDY----- FDYWGQGTLV TVSS

BMS2h-413 (SEQ ID NO: 117)
EVQLLESGGG LVQPGGSLRL SCAASGFTFE LYRMMWVRQA
PGKGLEWVSA ISSDGDTTYY ADSVKGRFTI SRDNSKNTLY
LQMNSLRAED TAVYYCAEHW LGTTLSRD- FDYWGQGTLV TVSS

BMS2h-414 (SEQ ID NO: 118)
EVQLLESGGG LVQPGGSLRL SCAASGFTFY RYTMAWVRQA
PGKGLEWVSQ ISPRGNITYY ADSVKGRFTI SRDNSKNTLY
LQMNSLRAED TAVYYCAKSG VAGAESPEY- FDYWGQGTLV TVSS

BMS2h-415 (SEQ ID NO: 119)
EVQLLESGGG LVQPGGSLRL SCAASGFTFL GYYMSWIRQA
PGKGLEWVST IGPIGGGTYY ADSVKGRFTI SRDNSKNTLY
LQMNSLRAED TAVYYCAKSQ NIYGP----- FDYWGQGTLV TVSS

BMS2h-416 (SEQ ID NO: 120)
EVQLLESGGG LVQPGGSLRL SCAASGFTFE QYDMAWVRQA
PGKGLEWVSE ISRDGGRTYY ADSVKGRFTI SRDNSKNTLY
LQMNSLRAED TAVYYCAEEY PY-------- FDYWGQGTLV TVSS

BMS2h-417 (SEQ ID NO: 121)
EVQLLESGGG LVQPGGSLRL SCAASGFTFP QYSMVWVRQA
PGKGLEWVST ISPLGSSTYY ADSVKGRFTI SRDNSKNTLY
LQMNSLRAED TAVYYCAKMS KLLLSRE--- FDYWGQGTLV TVSS

BMS2h-418 (SEQ ID NO: 122)
EVQLLESGGG LVQPGGSLRL SCAASGFTFA MYSMAWVRQA
PGKGLEWVSG ISPRGVETYY ADSVKGRFTI SRDNSKNTLY
LQMNSLRAED TAVYYCAKTN WNGVDL---- FDYWGQGTLV TVSS

BMS2h-419 (SEQ ID NO: 123)
EVQLLESGGG LVQPGGSLRL SCAASGFTFT RHGMAWVRQA
PGKGLEWVST ITPTGNTTYY ADSVKGRFTI SRDNSKNTLY
LQMNSLRAED TAVYYCAKDA HDEGY----- FDYWGQGTLV TVSS

BMS2h-42 (SEQ ID NO: 124)
EVQLLESGGG LVQPGGSLRL SCAASGFTFG PYEMTWVRQA
PGKGLEWVSS IVGDGLDTYY ADSVKGRFTI SRDNSKNTLY
LQMNSLRAED TAVYYCAKPD RV-------- FDYWGQGTLV TVSS

BMS2h-420 (SEQ ID NO: 125)
EVQLLESGGG LVQPGGSLRL SCAASGFTFG STPMMWVRQA
PGKGLEWVSE IRDTGLATYY ADSVKGRFTI SRDNSKNTLY
LQMNSLRAED TAVYYCASVS ---------- FDYWGQGTLV TVSS

BMS2h-421 (SEQ ID NO: 126)
EVQLLESGGG LVQPGGSLRL SCAASGFTFH LGDMHWVRQA
PGKGLEWVSS ISGTGHTTYY ADSVKGRFTI SRDNSKNTLY
LQMNSLRAED TAVYYCAKPM NDQG------ FDYWGQGTLV TVSS

BMS2h-422 (SEQ ID NO: 127)
EVQLLESGGG LVQPGGSLRL SCAASGFTFM DEDMLWVRQA
PGKGLEWVSR INSLGTHTYY ADSVKGRFTI SRDNSKNTLY
LQMNSLRAED TAVYYCAKSF MM-------- FDYWGQGTLV TVSS

BMS2h-423 (SEQ ID NO: 128)
EVQLLESGGG LVQPGGSLRL SCAASGFTFR NYQMHWVRQA
PGKGLEWVSG IDATGRATYY ADSVKGRFTI SRDNSKNTLY
LQMNSLRAED TAVYYCARST RS-------- FDYWGQGTLV TVSS

TABLE 1-continued

Anti-human CD40L VH Domain Amino Acid Sequences

BMS2h-424 (SEQ ID NO: 129)
EVQLLESGGG LVQPGGSLRL SCAASGFTFT NADMVWVRQA
PGKGLEWVSS ISGSGGSTYY ADSVKGRFTI SRDNSKNTLY
LQMNSLRAED TAVYYCAKGY LTSH------ FDYWGQGTLV TVSS

BMS2h-425 (SEQ ID NO: 130)
EVQLLESGGG LVQPGGSLRL SCAASGFTFR DYSMAWVRQA
PGKGLEWVST ITPSGLTTYY ADSVKGRFTI SRDNSKNTLY
LQMNSLRAED TAVYYCAEWS QAVTRS---- FDYWGQGTLV TVSS

BMS2h-426 (SEQ ID NO: 131)
EVQLLESGGD LVQPGGSLRL SCAASGFTFS DEGMMWVRQA
PGKGLEWVSE INQQGSATYY ADSVKGRFTI SRDNSKNTLY
LQMNSLRAED TAVYYCAKTI GM-------- FDYWGQGTLV TVSS

BMS2h-427 (SEQ ID NO: 132)
EVQLLESGGG LVQPGGSLRL SCAASGFTFT DQPMVWVRQA
PGKGLEWVSS IGARGGPTYY ADSVKGRFTV SRDNSKNTLY
LQMNSLRAED TAVYYCAKWF DIIAWDPFS- FDYWGQGTLV TVSS

BMS2h-428 (SEQ ID NO: 133)
EVQLLESGGG LVQPGGSLRL SCAASGFTFN QYPMMWVRQA
PGKGLEWVSS ITPSGFLTYY ADSVKGRFTI QRDNSKNTLY
LQMNSLRAED TAVYYCAEWN PFITT----- FDYWGQGTLV TVSS

BMS2h-429 (SEQ ID NO: 134)
EVQLLESGGG LVQPGGSLRL SCAASGFTFG HQQMAWVRQA
PGKGLEWVST ITPNGYYTYY ADSVKGRFTI SRDNSKNTLY
LQMNSLRAED TAVYYCAKFD YSLR------ FDYWGQGTLV TVSS

BMS2h-43 (SEQ ID NO: 135)
EVQLLESGGG LVQPGGSLRL SCAASGFTFA SYEMAWVRQA
PGKGLEWVSS IGSDGGPTYY ADSVKGRFTI SRDNSKNTLY
LQMNSLRAED SAVYYCAKPD RA-------- FDYWGQGTLV TVSS

BMS2h-430 (SEQ ID NO: 136)
EVQLLESGGG LVQPGGSLRL SCAASGFTFS AEQMTWARQA
PGKGLEWVST ITPHGDSTYY ADSVKGRFTI SRDNSKNTLY
LQMNSLRAED TAVYYCAKWR TLVDWPTSES FDYWGQGTLV TVSS

BMS2h-44 (SEQ ID NO: 137)
EVQLLESGGG LVQPGGSLRL SCAASGFTFT SYEMGWVRQA
PGKGLEWVSS IEPTGITTYY ADSVKGRFTI SRDNSKNTLY
LQMNSLRAED TAVYYCAKPH FTELG----- FDYWGQGTLV TVSS

BMS2h-449 (SEQ ID NO: 138)
EVQLLESGGG LVQPGGSLRL SCAASGFTFE GEQMAWVRQA
PGKGLEWVST ITLPGPYTFY ADSVKGRFTI SRDNSKNTLY
LQMNSLRAED TAVYYCAKGN GTF------- FDYWGQGTLV TVSS

BMS2h-45 (SEQ ID NO: 139)
EVQLLESGGG LVQPGGSLRL SCAASGFTFG NYAMAWVRQA
PGKGLEWVSK IGAQGLHTYY AGSVKGRFTI SRDNSKNTLY
LQMNSLRAED TAVYYCAKQT TMDYER---- FDYWGQGTLV TVSS

BMS2h-450 (SEQ ID NO: 140)
EVQLLESGGG LVQPGGSLRL SCAASGFTFD EVDMSWVRQA
PGKGLEWVSA IGNNGLKTYY ADSVKGRFTI SRDNSKNTLY
LQMNSLRAED TAVYYCAKSA LSYRPPV--- FDYWGQGTLV TVSS

BMS2h-451 (SEQ ID NO: 141)
EVQLLESGGG LVQPGGSLRL SCAASGFTFQ DDTMSWVRQA
PGKGLEWVST ITLKGPSTYY ADSVKGRFTI SRDNSKNTLY
LQMNSLRAED TAVYYCAKSR DGLY------ FDYWGQGTLV TVSS

BMS2h-452 (SEQ ID NO: 142)
EVQLLESGGG LVQPGGSLRL SCAASGFTFA SSPMAWVRQA
PGKGLEWVSS IGRDGSTTYY ADSVKGRFTI SRDNSKNTLY
LQMNSLRAED TAVYYCAKPS PYRR------ FDYWGQGTLV TVSS

BMS2h-453 (SEQ ID NO: 143)
EVQLLESGGG LVQPGGSLRL SCAASGFTFT DYSMVWVRQA
PGKGLEWVST IVSHGTTTYY ADSVKGRFTI SRDNSKNTLY
LQMNSLRAED TAVYYCAKGK GYNAQY---- FDYWGQGTLV TVSS

BMS2h-454 (SEQ ID NO: 144)
EVQLLESGGG LVQPGGSLRL SCAASGFTFG HQQMAWVRQA
PGKGLEWVST ITPNGYYTYY ADSVKGRFTI SRDNSKNTLY
LQMNSLRAED TAVYYCAKFD YSLR------ FDYWGQGTLV TVSS

BMS2h-455 (SEQ ID NO: 145)
EVQLLESGGG LVQPGGSLRL SCAASGFTFN DYDMIWVRQA
PGKGLEWVST ISSHGDSTYY ADSVKGRFTI SRDNSKNTLY
LQMNSLRAED TAVYYCAKGD VF-------- FDYWGQGTLV TVSS

BMS2h-456 (SEQ ID NO: 146)
EVQLLESGGG LVQPGGSLRL SCAASGFTFG HQQMAWVRQA
PGKGLEWVST ITPNGYYTYY ADSVKGRFTI SRDNSKNTLY
LQMNSLRAED TAVYYCAEWS DS-------- FDYRGQGTLV TVSS

BMS2h-457 (SEQ ID NO: 147)
EVQLLESGGG LVQPGGSLRL SCAASGFTFA DYEMAWVRQA
PGKGLEWVSG IQSNGNITYY ADSVKGRFTI SRDNSKNTLY
LQMNSLRAED TAVYYCAKAN SQVEY----- FDYWGQGTLV TVSS

BMS2h-458 (SEQ ID NO: 148)
EVQLLESGGG LVQPGGSLRL SCAASGFTFG VEPMSWVRQA
PGKGLEWVSN IGRDGSMTYY ADSVKGRFTI SRDNSKNTLY
LQMNSLRAED TAVYYCAKLG KHGT------ FDYWGQGTLV TVSS

BMS2h-459 (SEQ ID NO: 149)
EVQLLESGGG LVQPGGSLRL SCAASGFTFP EYRMMWVRQA
PGKGLEWVSW IDERGSLTYY ADSVKGRFTI SRDNSKNTLY
LQMNSLRAED TAVYYCAKRR KGTKQ----- FDYWGQGTLV TVSS

BMS2h-46 (SEQ ID NO: 150)
EVQLLESGGG LVQPGGSLRL SCAASGFTFE LYAMAWVRQA
PGKGLEWVSG IGAVGETTYY ADSVKGRFTI SRDNSKNTLY
LQMNSLRAED TAVYYCAKEA NNLSDNLV-FDYWGQGTLV TVSS

BMS2h-460 (SEQ ID NO: 151)
EVQLLESGGG LVQPGGSLRL SCAASGFTFG HQQMAWVRQA
PGKGLEWVST ITPNGYYTYY ADSVKGRFTI SRDNSKNTLY
LQMNSLRAED TAVYYCAKWS VEW------- FDYWGQGTLV TVSS

BMS2h-461 (SEQ ID NO: 152)
EVQLLESGGG LVQPGGSLRL SCAASGFTFN SYTMNWVRQA
PGKGLEWVSS INPWGSRTYY ADSVKGRFTI SRDNSKNTLY
LQMNSLRAED TAVYYCAKGL VL-------- FDYWGQGTLV TVSS

BMS2h-462 (SEQ ID NO: 153)
EVQLLESGGG LVQPGGSLRL SCAASGFTFD GDMMSWVRQA
PGKGLEWVSS ITQLGSRTYY ADSVKGRFTI SRDNSKNTLY
LQMNSLRAED TAVYYCAKQN WRTLT----- FDYWGQGTLV TVSS

BMS2h-463 (SEQ ID NO: 154)
EVQLLESGGG LVQPGGSLRL SCAASGFTFN AYGMMWVRQA
PGKGLEWVSS ILSDGVITYY ADSVKGRFTI SRDNSKNTLY
LQMNSLRAED TAVYYCAKSA RGANF----- FDYWGQGTLV TVSS

BMS2h-464 (SEQ ID NO: 155)
EVQLLESGGG LVQPGGSLRL SCAASGFTFG HYMMVWVRQA
PGKGLEWVSS ITPHGTSTYY ADSVKGRFTI SRDNSKNTLY
LQMNSLRAED TAVYYCAEFN AIFSEA---- FDYWGQGTLV TVSS

BMS2h-465 (SEQ ID NO: 156)
EVQLLESGGG LVQPGGSLRL SCAASGFTFR DYSMAWVRQA
PGKGLEWVST ITPSGLTTYY ADSVKGRFTI SRDNSKNTLY
LQMNSLRAED TAVYYCAEWS QAVTRS---- FDYWGQGTLV TVSS

BMS2h-466 (SEQ ID NO: 157)
EVQLLESGGG LVQPGGSLRL SCAASGFTFD LYAMAWVRQA
PGKGLEWVSM IGRDGRFTYY ADSVKGRFTI SRDNSKNTLY
LQMNSLRAED TAVYYCAKLA GSLRGR---- FDYWGQGTLV TVSS

BMS2h-467 (SEQ ID NO: 158)
EVQLLESGGG LVQPGGSLRL SCAASGFTFN KASMGWVRQA
PGKGLEWVST ITPHGSSTYY ADSVKGRFTI SRDNSKNTLY
LQMNSLRAED TAVYYCAKQR WGVE------ FDYWGQGTLV TVSS

BMS2h-468 (SEQ ID NO: 159)
EVQLLESGGG LVQPGGSLRL SCAASGFTFQ GYSMGWVRQA

TABLE 1-continued

Anti-human CD40L VH Domain Amino Acid Sequences

PGKGLEWVSS IAGRGGVTYY ADSVKGRFTI SRDNSKNTLY
LQMNSLRAED TAVYYCAKGL YIYHSL---- FDYWGQGTLV TVSS

BMS2h-469 (SEQ ID NO: 160)
EVQLLESGGG LVQPGGSLRL SCAASGFTFP GMEMSWVRQA
PGKGLEWVSA ITGTGSTTYY ADSVKGRFTI SRDNSKNTLY
LQMNSLRAED TAVYYCAKGY HP-------- FDYWGQGTLV TVSS

BMS2h-470 (SEQ ID NO: 161)
EVQLLESGGG LVQPGGSLRL SCAASGFTFP MVAMSWVRQA
PGKGLEWVSS IARDGNVTYY ADSVKGRFTI SRDNSKNTLY
LQMNSLRAED AAVYYCAKVS PTG------- FDYWGQGTLV TVSS

BMS2h-471 (SEQ ID NO: 162)
EVQLLESGGG LVQPGGSLRL SCAASGFTFG HQDMSWVRQA
PGKGLEWVSG ITDDGESTYY ADSVKGRFTI SRDNSKNTLY
LQMNSLRAED TAVYYCAKGD YD-------- FDYWGQGTLV
TVSS

BMS2h-472 (SEQ ID NO: 163)
EVQLLESGGG LVQPGGSLRL SCAASGFTFG EYNMMWVRQA
PGKGLEWVSQ ITRDGSRTYY ADSVRGRFTI SRDNSRNTLY
LQMNSLRAED SAVYYCAKLS NIG------- FDYWGQGTLV TVSS

BMS2h-473 (SEQ ID NO: 164)
EVQLLESGGG LVQPGGSLRL SCAASGFTFS DYSMIWARQA
PGKGLEWVSS ITPYGSYTYY ADSVKGRFTI SRDNSKNTLY
LQMNSLRAED TAVYYCAKTD YL-------- FDYWGQGTLV TVSS

BMS2h-474 (SEQ ID NO: 165)
EVQLLESGGG LVQPGGSLRL SCAASGFTFD TYSMMWVRQA
PGKGLEWVST ITPYGSSTYY ADSVKGRFTI SRDNSKNTLY
LQMNSLRAED TAVYYCAKWG LV-------- FDYWGQGTLV TVSS

BMS2h-475 (SEQ ID NO: 166)
EVQLLESGGG LVQPGGSLRL SCAASGFTFT TGPMMWVRQA
PGKGLEWVSA IGIGGDTTYY ADSVKGRFTI SRDNSKNTLY
LQMNSLRAED TAVYYCAKLT PSNQ------ FDYWGQGTLV TVSS

BMS2h-476 (SEQ ID NO: 167)
EVQLLESGGG LVQPGGSLRL SCAASGFTFK QYQMMWVRQA
PGKGLEWVSS ITPSGPLTYY ADSVKGRFTI SRDNSKNTLY
LQMNSLRAED TAVYYCAEWN PFIST----- FDYWGQGTLV TVSS

BMS2h-477 (SEQ ID NO: 168)
EVQLLESGGG LVQPGGSLRL SCAASGFTFP NYDMVWVRQA
PGKGLEWVSS ISALGNVTYY ADSVKGRFTI SRDNSKNTLY
LQTNSLRAED TAVYYCAKWR SAITGN---- FDYWGQGTLV TVSS

BMS2h-478 (SEQ ID NO: 169)
EVQLLESGGG LVQPGGSLRL SCAASGFTFK EYQMSWVRQA
PGKGLEWVST ISPSGMNTYY ADSVKGRFTI SRDNSKNTLY
LQMNSLRAED TAVYYCAEWR SVVRPWPGV- FDYWGQGTLV TVSS

BMS2h-479 (SEQ ID NO: 170)
EVQLLESGGG LVQPGGSLRL SCAASGFTFD DESMAWVRQA
PGKGLEWVSS ITPHGTFTYY ADSVKGRFTI SRDNSKNTLY
LQMNSLRAED TAVYYCAKLH LKLYESH--- FDYWGQGTLV TVSS

BMS2h-480 (SEQ ID NO: 171)
EVQLLESGGG LVQPGGSLRL SCAASGFTFE GGEMGWVRQA
PGKGLEWVSM IPMDGSATYY ADSVKGRFTI SRDNSKNTLY
LQMNSLRAED TAVYYCAKAG ST-------- FDYWGQGTLV TVSS

BMS2h-481 (SEQ ID NO: 172)
EVQLLESGGG LVQPGGSLRL SCAASGFTFD FMPMAWVRQA
PGKGLEWVSS IGRDGAYTYY ADSVKGRFTI SRDNSKNTLY
LQMNSLRAED TAVYYCAKLA SPAQ------ FDYWGQGTLV TVSS

BMS2h-482 (SEQ ID NO: 173)
EVQLLESGGG LVQPGGSLRL SCAASGFTFG DEPMLWVRQA
PGKGLEWVSS IGGTGTTTYY ADSVKGRFTI SRDNSKNTLY
LQMNSLRAED TAVYYCAKGN QGDFINR--- FHYWGQGTLV TVSS

BMS2h-483 (SEQ ID NO: 174)
EVQLLESGGG LVQPGGSLRL SCAASGFTFH AYNMAWVRQA
PGKGLEWVST ISPRGSYTYY ADSVKGRFTI SRDNSKNTLY
LQMNSLRAED TAVYYCAKWP PPSSH----- FDYWGQGTLV TVSS

BMS2h-5 (SEQ ID NO: 175)
EVQLLESGGG LVQPGGSLRL SCAASGFTFD GYEMAWVRQA
PGKGLEWVSS ITSDGTSTYY ADSVKGRFTI SRDNSKNTLY
LQMNSLRAED TAVYYCAKPG LR-------- FDYWGQGTLV TVSS

BMS2h-505 (SEQ ID NO: 176)
EVQLLESGGG LVQPGGSLRL SCAASGFTFE GYMMYWVHQA
PGKGLEWVSS ISPQGHFTYY ADSVKGRFTI SRDNSKNTLY
LQMNSLRAED TAVYYCAELR ELPRL----- FDYWGQGTLV TVSS

BMS2h-506 (SEQ ID NO: 177)
EVQLLESGGG LVQPGGSLRL SCAASGFTFS SYAMGWVRQA
PGKGLEWVSS IDASGGPTYY ADSVKGRFTI SRDNSKNTLY
LQMNSLRAED TAVYYCAKAN GKKFPFTKY- FDYWGQGTLV TVSS

BMS2h-507 (SEQ ID NO: 178)
EVQLLESGGG LVQPGGSLRL SCAASGFTFP SVHMAWVRQA
PGKGLEWVSG INLTGVDTYY ADSVKGRFTI SRDNSKNTLY
LQMNSLRAED TAVYYCAKSA TTRQAHPLY- FDYWGQGTLV TVSS

BMS2h-515 (SEQ ID NO: 179)
EVQLLESGGG LVQPGGSLRL SCAASGFTFK EGEMYWVRQA
PGKGLEWVST ISTNGLTTYY ADSVKGRFTI SRDNSKNTLY
LQMNSLRAED TAVYYCAKST RDLG------ FAYWGQGTLV TVSS

BMS2h-516 (SEQ ID NO: 180)
EVQLLESGGG LVQPGGSLRL SCAASGFTFE EYEMAWARQA
PGKGLEWVSF ISPRGHFTYY ADSVKGRFTI SRDNSKNTLY
LQMNSLRAED TAVYYCAKPA KT-------- FDYWGQGTLV TVSS

BMS2h-517 (SEQ ID NO: 181)
EVQLLESGGG LVQPGGSLRL SCAASGFTFD TYEMLWVRQA
PGKGLEWVSR ISVDGSITYY ADSVKGRFTI SRDNSKNTLY
LQMNSLRAED TAVYYCAKTR MR-------- FDYWGQGTLV TVSS

BMS2h-518 (SEQ ID NO: 182)
EVQLLESGGG LVQPGGSLRL SCAASGFTFS SYAMSWVRQA
PGKGLEWVSN ISRDGSKTYY ADSVKGRFTI SRDNSKNTLY
LQMNSLRAED TAVYYCAEAQ SGGLRSGLTT FDYWGQGTLV TVSS

BMS2h-519 (SEQ ID NO: 183)
EVQLLESGGG LVQPGGSLRL SCADSGFTFS SYAMSWVRQA
PGKGLEWVSS IGRDGAYTYY ADSVKGRFTI SRDNSKNTLY
LQMNSLRAED TAVYYCAKAG PKGIA----- FDYWGQGTLV TVSS

BMS2h-520 (SEQ ID NO: 184)
EVQLLESGGG LVQPGGSLRL SCAASGFTFS PHAMAWVRQA
PGKGLEWVSG IDGGGSMTYY ADSVKGRFTI SRDNSKNTLY
LQMNSLRAED TAVYYCAKSD PP-------- FDYWGQGTLV TVSS

BMS2h-521 (SEQ ID NO: 185)
EVQLLESGGG LVQPGGSLRL SCAASGFTFH AGEMHWVRQA
PGKGLEWVSS ITLPGDMTYY ADSVKGRFTI SRDNSKNTLY
LQMNSLRAED TAVYYCAKPN TGYT------ FDYWGQGTLV TVSS

BMS2h-522 (SEQ ID NO: 186)
EVQLLESGGG LVQPGGSLRL SCAASGFTFG NYGMSWVRQA
PGKGLEWVSS ISWDGSLTYY ADSVKGRFTI SRDNSKNTLY
LQMNSLRAED TAVYYCAQNT RL-------- FDYWGQGTLV TVSS

BMS2h-523 (SEQ ID NO: 187)
EVQLLESGGG LVQPGGSLRL SCAASGFTFH DADMLWVRQA
PGKGLEWVSG ILSPGEDTYY ADSVKGRFTI SRDNSKNTLY
LQMNSLRAED TAVYYCAKFG LP-------- FDYWGQGTLV TVSS

BMS2h-524 (SEQ ID NO: 188)
EVQLLESGGG LVQPGGSLRL SCAASGFTFR TDQMNWVRQA
PGKGLEWVSS ISPSGAYTYY ADSVKGRFTI SRDNSKNTLY
LQMNSLRAED TAVYYCAKGL GA-------- FDYWGQGTLV TVSS

BMS2h-525 (SEQ ID NO: 189)
EVQLLESGGG LVQPGGSLRL SCAASGFIFE QYQMVWVRQA
PGKGLEWVSW ISPDGTHTYY ADSVKGRFTI SRDNSKNTLY
LQMNSLRAED TAVYYCAKFS LRKMEK---- FDYWGQGTLV TVSS

BMS2h-526 (SEQ ID NO: 190)
EVQLLESGGG LVQPGGSLRL SCAASGFTFQ DEQMAWVRQA

TABLE 1-continued

Anti-human CD40L VH Domain Amino Acid Sequences

PGKGLEWVSS IASDGMSTYY ADSVKGRFTI SRDNSKNTLY
LQMNSLRAED TAVYYCAQPG KN-------- FDHWGQGTLV TVSS

BMS2h-527 (SEQ ID NO: 191)
EVQLLESGGG LVQPGGSLRL SCAASGFTFS DYAMSWVRQA
PGKGLEWVSS ITTGGERTYY ADSVKGRFTI SRDNSKNTLY
LQMNSLRAED TAVYYCAKRW NLYTES---- FDYWGQGTLV TVSS

BMS2h-528 (SEQ ID NO: 192)
EVQLLESGGG LVQPGGSLRL SCAASGFTFG GQPMDWVRQA
PGKGLEWVSS IAPDGIHTYY ADSVKGRFTI SRDNSKNTLY
LQMNSLRAED TAVYYCAKNL GQG------- FDYWGQGTLV TVSS

BMS2h-529 (SEQ ID NO: 193)
EVQLLESGGG LVQPGGSLRL SCAASGFTFE RYQMTWVRQA
PGKGLEWVSS ISPSGTFTYY ADSVKGRFTI SRDNSKNTLY
LQMNSLRAED TAVYYCAEWK AL-------- FDYWGQGTLV TVSS

BMS2h-530 (SEQ ID NO: 194)
EVQLLESGGG LVQPGGSLRL SCAASGFTFP HSTMYWVRQA
PGKGLEWVSL ILPSGSRTYY ADSVKGRFTI SRDNSKNTLY
LQMNSLRAED TAVYYCAKFS DER------- FDYWGQGTLV TVSS

BMS2h-531 (SEQ ID NO: 195)
EVQLSESGGG LVQPGGSLRL SCAASGFTFG DGNMDWVRQA
PGKGLEWVSG ISSDGVTTYY ADSVKGRFTI SRDNSKNTLY
LQMNSLRAED TAVYYCAKDR GQG------- FDYWGQGTLV TVSS

BMS2h-532 (SEQ ID NO: 196)
EVQLLESGGG LVQPGGSLRL SCAASGFTFD DYMMWWVRQA
PGKGLEWVSS ISPHGVYTYY ADSVKGRFTI SRDNSKNTLY
LQMNSLRAED TAVYYCAKWL HT-------- FDYWGQGTLV TVSS

BMS2h-533 (SEQ ID NO: 197)
EVQLLESGGG LVQPGGSLRL SCAASGFTFS NYTMAWGRQA
PGKGLEWVSF IAGPGNYTYY ADSVKGRFTI SRDNSKNTLY
LQMNSLRAED TAVYYCAKPG STATYNNGQ- FDYWGQGTLV TVSS

BMS2h-534 (SEQ ID NO: 198)
EVQLLESGGG LVQPGGSLRL SCAASGFTFT EYSMVWVRQA
PGKGLEWVSS ISGSGRVTYY ADSVKGRFTI SRDNSKNTLY
LQMNSLRAED TAVYYCAKWL KLVRAPNP-FDYWGQGTLV TVSS

BMS2h-535 (SEQ ID NO: 199)
EVQLLESGGG LVQPGGSLRL SCAASGFTFS NYQMAWVRQA
PGKGLEWVSG ISKTGHSTYY ADSVKGRFTI SRDNSRNTLY
LQMNSLRAED TAVYYCAKAS HSLGPL---- FDYWGQGTLV TVSS

BMS2h-54 (SEQ ID NO: 200)
EVQLLESGGG LVQPGGSLRL SCAASGFTFT AYRMAWVRQA
PGKGLEWVSW ISPSGSGTYY ADSVKGRFTI SRDNSKNTLY
LQMNSLRAED TAVYYCAKTL TDSPSGHYE- FDYWGQGTLV TVSS

BMS2h-55 (SEQ ID NO: 201)
EVQLLESGGG LVQPGGSLRL SCAASGFTFA RYEMGWVRQA
PGKGLEWVSR ITAQGLGTYY ADSVKGRFTI SRDNSKNTLY
LQMNSLRAED TAVYYCAKYL TDFSSGHQE- FDYWGQGTLV TVSS

BMS2h-553 (SEQ ID NO: 202)
EVQLLESGGG LVQPGGSLRL SCAASGFTFD DYGMSWVRQV
PGKGLEWVSG ISHNGMLTYY ADSVKGRFTI SRDNSKNTLY
LQMNSLRAED TAVYYCAKYW PSTSWETD-FDYWGQGTLV TVSS

BMS2h-554 (SEQ ID NO: 203)
EVQLLESGGG SVQPGGSLRL SCAASGFTFG NEPMAWVRQA
PGKGLEWVSS IEMQGKNTYY ADSVKGRFTI SRDNSKNTLY
LQMNSLRAED TAVYYCAKDR GQG------- FDYWGQGTLV TVSS

BMS2h-555 (SEQ ID NO: 204)
EVQLLESGGG LVQPGGSLRL SCAASGFTFG EEEMSWVRQA
PGKGLEWVSC IDNLGSPTYY ADSVKGRFTI SRDNSKNTLY
LQMNSLRAED AAVYYCAKTI SHQYDR---- FDYWGQGTLV TVSS

BMS2h-556 (SEQ ID NO: 205)
EVQLLESGGG LVQPGGSLRL SCAASGFTFG EEEMSWVRQA
PGKGLEWVSS IDEGGRWTYY ADSVKGRFTI SRDNSKNTLY
LQMNSLRAED TAVYYCAKWT PHKQLS---- FDYWGQGTLV TVSS

BMS2h-557 (SEQ ID NO: 206)
EVQLLESGGG LVQPGGSLRL SCAASGFSFA DEYMVWARQA
PGKGLEWVSE IDPLGTGTYY ADSVKGRFTI SRDNSKNTLY
LQMNSLRAED TAVYYCAKYG TA-------- FDYWGQGTLV TVSS

BMS2h-558 (SEQ ID NO: 207)
EVQLLESGGG LVQPGGSLRL SCAASGFTFS THDMMWVRQA
PGKGLEWVSS ISDDGISTYY ADSVKGRFTI SRDNSKNTLY
LQMNSLRAED TAVYYCAKPD MSLIE----- FDYWGQGTLV TVSS

BMS2h-559 (SEQ ID NO: 208)
EVQLLESGGG LVQPGGSLRL SCAASGFTFD GTPMVWVRQA
PGKGLEWVSG ISGDGRNTYY ADSVKGRFTI SRDNSKNTLY
LQMNSLRAED TAVYYCAEPY ALTSSKP--- FDYWGQGTLV TVSS

BMS2h-56 (SEQ ID NO: 209)
EVQLLESGGG LVQPGGSLRL SCAASGFTFN DYTMGWVRQA
PGKGLEWVSW IHGTGGQTYY ADSVKGRFTI SRDNSKNTLY
LQMNSLRAED TAVYYCAKAL ADRSGGVVE- FDYWGQGTLV TVSS

BMS2h-560 (SEQ ID NO: 210)
EVQLLESGGG LVQPGGSLRL SCAASGFTFE AETMAWVRQA
PGKGLEWVSC ISNDGNTTYY ADSVKGRFTI SRDNSKNTLY
LQMNSLRAED TAVYYCAKES LISPGL---- FDYWGQGTLV TVSS

BMS2h-561 (SEQ ID NO: 211)
EVQLLESGGG LVQPGGSLRL SCAASGFTFT GEYMNWVRQA
PGKGLEWVST INETGYMTYY ADSVKGRFTI SRDNSKNTLY
LQMNSLRAED TAVYYCAKLS TRGVP----- FDYWGQGTLV TVSS

BMS2h-562 (SEQ ID NO: 212)
EVQLLESGGG LVQPGGSLRL SCAASGFTFR SYDMGWVRQA
PGKGLEWVST ISPMGVFTYY ADSVKGRFTI SRDNSKNTLY
LQMNSLRAED TAVYYCAKSN QHAHDP---- FDYWGQGTLV TVSS

BMS2h-563 (SEQ ID NO: 213)
EVQLLESGGG LVQPGGSLRL SCAASGFTFS DYDMGWVRQA
PGKGLEWVSS ISPMGTFTYY ADSVKGRFTI SRDNSKNTLY
LQMNSLRAED TAVYYCAKAA LTEPM----- FDYWGQGTLV TVSS

BMS2h-564 (SEQ ID NO: 214)
EVQLLESGGG LVQPGGSLRL SCAASGFTFR DYDMGWVRQA
PGKGLEWVST ISPLGHFTYY ADSVKGRSTI SRDNSKNTLY
LQMNSLRAED TAVYYCAKAE EA-------- FDYWGQGTLV TVSS

BMS2h-565 (SEQ ID NO: 215)
EVQLLESGGG LVQPGGSLRL SCAASGFAFP RYGMTWVRQA
PGKGLEWVSN IDQFGMKTYY ADSVKGRFTI SRDNSKNTLY
LQMNSLRAED TAVYYCAEEY AS-------- FDYWGQGTLV TVSS

BMS2h-566 (SEQ ID NO: 216)
EVQLLESGGG LVQPGGSLRL SCAASGFTFD KYDMGWVRQA
PGKGLEWVST ISPMGVFTYY ADSVKGRFTI SRDNSKNTLY
LQMNSLRAED TAVYYCAKGR GNTSD----- FDYWGQGTLV TVSS

BMS2h-567 (SEQ ID NO: 217)
EVQLLESGGG LVQPGGSLRL SCAASGFTFS NYDMAWVRQA
PGKGLEWVST ISGAGHFTYY ADSVKGRFTI SRDNSKNTLY
LQMNSLRAED TAVYYCAKSF PRDE------ FDYWGQGTLV TVSS

BMS2h-568 (SEQ ID NO: 218)
EVQLLESGGG LVQPGGSLRL SCAASGFTFP KYEMRWVRQA
PGKGLEWVSE IGLDGSPTYY ADSVKGRFTI SRDNSKNTLY
LQMNSLRAED TAVYYCAKLG DPNG------ FDYWGQGTLV TVSS

BMS2h-569 (SEQ ID NO: 219)
EVQLLESGGG LVQPGGSLRL SCAASGFTFP TSEMDWVRQA
PGKGLEWVSG IGPDGLTTYY ADSVKGRFTI SRDNSKNTLY
LQMNSLRAED TAVYYCAKHA DW-------- FDYWGQGTLV TVSS

BMS2h-57 (SEQ ID NO: 220)
EVQLLESGGG LVQPGGSLRL SCAASGFTFS EYDMYWVRQA
PGKGLEWVSW IDTDGGDTYY ADSVKGRFTI SRDNSKNTLY
LQMNSLRAED TAVYYCAKPG LK-------- FDYWGQGTLV TVSS

TABLE 1-continued

Anti-human CD40L VH Domain Amino Acid Sequences

BMS2h-570 (SEQ ID NO: 221)
EVQLLESGGG LVQPGGSLRL SCTASGFTFE NASMQWVRQA
PGKGLEWVSS IEGQGNATYY ADSVKGRFTI SRDNSKNTLY
LQMNSLRAED TAVYYCAKSS SWS------ FDYWGQGTLV TVSS

BMS2h-571 (SEQ ID NO: 222)
EVQLLESGGG LVQPGGSLRL SCAASGFTFT RNEMGWVRQA
PGKGLEWVST ITPTGTFTYY ADSVKGRFTI SRDNSKNTLY
LQMNSLRAED TAVYYCAKTD PGNRY----- FDYWGQGTLV TVSS

BMS2h-572 (SEQ ID NO: 223)
EVQLLESGGG LVQPGGSLRL SCAASGFTFN WQLMGWVRQA
PGKGLEWVSG IEGPGDVTYY ADSVKGRFTI SRDNSKNTLY
LQMNSLRAED TAVYYCAKVG KESN------ FDYRGQGTLV TVSS

BMS2h-572-1 (SEQ ID NO: 224)
EVQLLESGGG LVQPGGSLRL SCAASGFTFN WQLMGWFRQA
PGKGLEWVSG IEGPGDVTYY ADSVKGRFTI SRDNSKNTLY
LQMNSLRAED TAVYYCAKVG KESN------ FDYRGQGTLV TVSS

BMS2h-572-10 (SEQ ID NO: 225)
EVQLLESGGG LVQPGGSLRL SCAASGFTFN WQLMGWVRQA
PGKGLEWVSG IEGPGDVTYY ADSVKGRFTV SRDNSKNTLY
LQMNSLRAED TAVYYCAKVG KESN------ SDYRGQGTLV TVSS

BMS2h-572-11 (SEQ ID NO: 226)
EVQLLESGGG LVQPGGSLRL SCAASGFTFN WQLMGWVRQA
PGKGLEWVSG IEGPGDVTYY ADSVKGRFTI SRDNSKNTLY
LQMNSLRAED TAVYYCVKVG KESN------ SDYRGQGTQV TVSS

BMS2h-572-12 (SEQ ID NO: 227)
EVQLLESGGG LVQPGGSLRL SCAASGFTFN WQLMGWARQA
PGKGLEWVSG IEGPGDVTYY ADSVKGRFTI SRDNSKNTLY
LQMNSLRAED TAVYYCAKVG KESN------ SDYRGQGTLV TVSS

BMS2h-572-13 (SEQ ID NO: 228)
EVQLLESGGG LVQPGGSLRL SCAASGFTFN WQLMGWARQA
PGKGLEWVSG IEGPGDVTYY ADSVKDRFTI SRDNSKNTLY
LLMNSLRAED TAVYYCAKVG KESN------ FDYWGQGTLV TVSS

BMS2h-572-14 (SEQ ID NO: 229)
EVQLLESGGG LVQPGGSLRL SCAASGFTFN WQLMGWVRQA
PGKGLEWVSG IEGPGDVTYY ADSVKGRFTI SRDNTKNTLY
LQMNSLRAED TAVYYCVKVG KESN------ SDYRGQGTLV TVSS

BMS2h-572-15 (SEQ ID NO: 230)
EVRLLESGGG LVQPGGSLRL SCAASGFNFN WQLMGWIRQA
PGKGLEWVSG IEGPGDVTYY ADSVKGRFTI SRDNSKNTLY
LQMNSLRAED TAVYYCAKVG KESN------ SDYRGQGTLV TVSS

BMS2h-572-16 (SEQ ID NO: 231)
EVQLLESGGG LVRPGGSLRL SCVASGFTFN WQLMGWVRQA
PGKGLEWVSG IEGPGDVTYY ADSVKGRFTI SRDNSKNTLY
LQMNSLRAED TAVYYCAKVG KESN------ FDYRGQGTLV TVSS

BMS2h-572-17 (SEQ ID NO: 232)
EVQLLESGGG LVQTGGSLRL SCAASGFTYN WQLMGWVRQA
PGKGLEWVSG IEGPGDVTYY ADSVKGRFTI SRDNSKNTLY
LQMNSLRADD TAVYYCVKVG KESN------ FDYRGHGTLV TVSS

BMS2h-572-18 (SEQ ID NO: 233)
EVQLLESGGG LVQPGGSLRL SCAASGFTFN WQLMGWVRKA
PGKGLEWVSG IEGPGDVTYY ADSVKGRFTI SRDNSKNTLY
LQMNSLRAED TAVYYCAKVG KESN------ SDYRGQGTLV TVSS

BMS2h-572-19 (SEQ ID NO: 234)
EVQLLESGGG LVQPGGSLRL SCAASGFTFN WQLMGWVRQA
PGKGLEWVSG IEGPGDVTYY ADSVKGRFTI SRDNTKNTLY
LQMNSLRAED TAVYYCAKVG KESN------ FDYRGQGTLV TVSS

BMS2h-572-2 (SEQ ID NO: 235)
EVQLLESGGG LVQPGGSLRL SCAASGFTFN WQLMGWVRQA
PGKGLEWVSG IEGPGDVTYY ADSVKGRFTI SRDNSKNTLY
LQMNSLRAED TAVYYCAKVG KESK------ FDYLGQGTLV TVSS

BMS2h-572-21 (SEQ ID NO: 236)
EVQLLESGGG LVQPGGSLRL SCAASGFTFN WQLMGWVRQA
PGKGLEWVSG IEGPGDVTYY AESVKGRFTI SRDNSKNTLY
LQMNSLRAED TAVYYCAKVG KESN------ LDYRGQGTLV TVSS

BMS2h-572-22 (SEQ ID NO: 237)
EVQLFESGGG SVQPGGSLRL SCAASGFTFN WQLMGWVRQA
PGKGLEWVSG IEGPGDVTYY ADSVKGRFTI SRDNSKNTLY
LQMNSLRAED TAVYYCAKVG KESN------ SDYRGQGTLV TVSS

BMS2h-572-23 (SEQ ID NO: 238)
EVQLLESGGG LVQPGGSLRL TCAASGFTFN WQLMGWVRQA
PGKGLEWVSG IEGPGDVTYY ADSVKGRFII SRDNSKNTLY
LQMNSLRAED TAVYYCAKVG KESN------ SDYRGQGTLV TVSS

BMS2h-572-24 (SEQ ID NO: 239)
EVQLLESGGG LVQPGGSLRL SCAASGFTFN WQLMGWVRQA
PGKGLEWVSG IEGPGDVTYY ADSVKGRFTI SRDNSTNTLY
LQMNSLRAED TAVYYCAKVG KESE------ FDYRGQGTLV TVSS

BMS2h-572-3 (SEQ ID NO: 240)
EVRLLESGGG LVQPGGSLRL SCAASGFTFN WQLMGWVRQA
PGKGLEWVSG IEGPGDVTYY ADSVKGRFTI TRDNSKNTLY
LQMNSLRAED TAVYYCVKVG KESN------ LDYRGQGTLV TVSS

BMS2h-572-4 (SEQ ID NO: 241)
EVQLLVSGGG LVQPGGSLRL SCAASGFTFN WQLMGWVRQA
PGKGLEWVSG IEGPGDVTYY ADSVKGRFTI SRDNSKNTLY
LQMNSLRAED TAVYYCAKVG KESN------ FDYRGQGTLV TVSS

BMS2h-572-5 (SEQ ID NO: 242)
EVQLLVSGGG LVQPGGSLRL SCAASGFTFN WQLMGWVRQA
PGKGLEWVSG IEGPGDVTYY ADSVKGRFTI SRDNSKNMLY
LQMNGLRAED TAVYYCAKVG KESN------ FDYRGQGTLV TVSS

BMS2h-572-6 (SEQ ID NO: 243)
EVQLLESGGG LVQPGGSLRL SCAASGFTFN WQLMGWVRQA
PGKGLEWVSG IEGPGDVTYY ADSVKGRFTI SRDNSKNTLY
LQMNSLRAED TAVYYCVKVG KESN------ SDYRGQGTLV TVSS

BMS2h-572-601 (SEQ ID NO: 244)
EVQLLESGGG LVQPGGSLRL SCAASGFTFK WQLMGWARQA
PGKGLEWVSG IEGPGDVTYY ADPVKGRFTI SRDNSKNTLY
LQMNSLRAED TAVYYCVKVG KESN------ SDYRGQGTLV TVSS

BMS2h-572-602 (SEQ ID NO: 245)
EVQLLESGGG LVQPGGSLRL SCAASGFTFK WHLMGWVRQA
PGKGLEWVSG IEGPGDVTYY ADSVKGRFTI SRDNSKNTLY
LQMNSLRAED TAVYYCVKVG KESS------ SDYRGQGTLV TVSS

BMS2h-572-603 (SEQ ID NO: 246)
EVQLLESGGG LVQPGGSLRL SCAASGFTFN WHLMAWARQA
PGKGLEWVSG IEGPGDVTYY ADSVKGRFTI SRDNSKNTLY
LQMNSLRAED TAVYYCVKVG KESN------ SDYRGQGTLV TVSS

BMS2h-572-604 (SEQ ID NO: 247)
EVQLLESGGG LVQPGGSLRL SCAASGFTFK WQLMGWVRQA
PGKGLEWVSG IEGPGDVTYY ADSVKGRFTI SRDNSKNTLY
LQMNSLRAED TAVYYCVKVG KESN------ SDYRGQGTLV TVSS

BMS2h-572-605 (SEQ ID NO: 248)
EVQLLESGGG LVQPGGSLRL SCAASGFTFK WQLMAWARQA
PGKGLEWVSG IEGPGDITYY ADSVKGRFTI SRDNSKNTLY
LQMNSLRAED TAVYYCVKVG KESN------ SDYRGQGTLV TVSS

BMS2h-572-606 (SEQ ID NO: 249)
EVQLLESGGG LVQPGGSLRL SCAASGFTFN WHLMGWARQA
PGKGLEWVSG IEGPGDVTYY ADSVKGRFTI SRDNSKNTLY
LQMNSLRAED TAVYYCVKVG KESN------ SDYRGQGTLV TVSS

BMS2h-572-607 (SEQ ID NO: 250)
EVQLLESGGG LVQPGGSLRL SCAASGFTFK WQLMGWARQA
PGKGLEWVSG IEGPGDVTYY ADSVKGRFTI SRDNSKNTLY
LQMNSLRAED TAVYYCVKVG KESN------ SDYRGQGTLV TVSS

BMS2h-572-608 (SEQ ID NO: 251)
EVQLLESGGG LVQPGGSLRL SCAASGFTFN WELMGWARQA
PGKGLEWVSG IEGPGDVTYY ADSVKGRFTI SRDNSKNTLY
LQMNSLRAED TAVYYCVKVG KESN------ SDYRGQGTLV TVSS

TABLE 1-continued

Anti-human CD40L VH Domain Amino Acid Sequences

BMS2h-572-609 (SEQ ID NO: 252)
EVQLLESGGG LVQPGGSLRL SCAASGFTFN WQLMGWARQA
PGKGLEWVSG IEGPGDVTYY ADSVKGRFTI SRDNSKNTLY
LQMNSLRAED TAVYYCVKVG KESN------ SDYRGQGTLV TVSS

BMS2h-572-610 (SEQ ID NO: 253)
EVQLLESGGG LVQPGGSLRL SCAASGFTFN WQLMGWVRQA
PGKGLEWVSG IEGPGDVTYY ADSVKGRFTI SRDNSKNTLY
LQMNSLRAED TAVYYCVKVG KDSK------ SDYRGQGTLV TVSS

BMS2h-572-611 (SEQ ID NO: 254)
EVQLLESGGG LVQPGGSLRL SCAASGFTFN WQLMGWVRRA
PGKGLEWVSG IEGPGDVTYY ADSVKGRFTI SRDNSKNTLY
LQMNSLRAED TAVYYCVKVG KDSK------ SDYRGQGTLV TVSS

BMS2h-572-612 (SEQ ID NO: 255)
EVQLLESGGG LVQPGGSLRL SCAASGFTFN WQLMGWVRQA
PGKGLEWVSG IEGPGDVTYY ADSVKGRFTI SRDNSKNTLY
LQMNSLRAED TAVYYCVKVG KDSN------ SDYRGQGTLV TVSS

BMS2h-572-613 (SEQ ID NO: 256)
EVQLLESGGG LAQPGGSLRL SCAASGFTFN WQLMGWVRQA
PGKGLEWVSG IEGPGDVTYY ADSVKGRFTI SRDNSKNTLY
LQMNSLRAED TAVYYCVKVG KDSK------ SDYRGQGTLV TVSS

BMS2h-572-614 (SEQ ID NO: 257)
EVQLLESGGG LVQPGGSLRL SCAASGFTFN WQLMGWVRQA
PGKGLEWVSG IEGPGDVTYY ADSVKGRFTI SRDNSKNTLY
LQMNSLRAED TAVYYCVKVG KDAK------ SDYRGQGTLV TVSS

BMS2h-572-615 (SEQ ID NO: 258)
EVQLLESGGG LVQPGGSLRL SCAASGFTFN WQLMGWVRQA
PGKGLEWVSG IEGPGDVTYY ADSVKGRFTI SRDNSKNTLY
LQMNSLRAED TAVYYCVKVG KDKN------ SDYRGQGTLV TVSS

BMS2h-572-616 (SEQ ID NO: 259)
EVQLLESGGG LVQPGGSLRL SCAASGFTFN WQLMGWVRQA
PGKGLEWVSG IEGPGDVTYY ADSVKGRFTI SRDNSKNTLY
LQMNSLRAED TAVYYCVKVG KESK------ SDYRGQGTLV TVSS

BMS2h-572-617 (SEQ ID NO: 260)
EVQLLESGGG LVQPGGSLRL SCAASGFTFN WQLMGWVRQA
PGKGLEWVSG IEGPGDVTYY ADSVKGRFTI SRDNSKNTLY
LQMNSLRAED TAVYYCVKVG RDSK------ SDYRGQGTLV TVSS

BMS2h-572-618 (SEQ ID NO: 261)
EVQLLESGGG LVQPGGSLRL SCAASGFTFN WQLMGWVRQA
PGKGLEWVSG IEGPGDVTYY ADSVKGRFTI SRDNSKNTLY
LQMNSLRAED TAVYYCVKVG KYSN------ SDYRGQGTLV TVSS

BMS2h-572-619 (SEQ ID NO: 262)
EVQLLESGGG LVQPGGSLRL SCAASGFTFN WQLMGWVRQA
PGKGLEWVSG IEGPGDVTYY ADSVKGRFTI SRDNSKNTLY
LQMNSLRAED TAVYYCVKVG KDSR------ SDYRGQGTLV TVSS

BMS2h-572-620 (SEQ ID NO: 263)
EVQLLESGGG LVQPGGSLRL SCAASGFTFN WQLMGWVRQA
PGKGLEWVSG IEGPGDVTYY ADSVKGRFTI SRDNSKNTLY
LQMNSLRAED TAVYYCVKVG KDDS------ SDYRGQGTLV TVSS

BMS2h-572-621 (SEQ ID NO: 264)
EVQLLEFGGG LVQPGGSLRF SCAASGFTFN WQLMGWFRQA
PGKGLEWVSG IEGPGDVTYY ADSVKGRFTI SRDNSKNTLY
LQMNSLRAED TAVYYCVKVG RDSN------ SDYRGQGTLV TVSS

BMS2h-572-622 (SEQ ID NO: 265)
EVQLLESGGG LVQPGGSLRL SCAASGFTFN WQLMGWVRQA
PGKGLEWVSG IEGPGDVTYY ADSVKGRFTI SRDNSKNTLY
LQMNSLRAED TAVYYCVKVG KDST------ SDYRGQGTLV TVSS

BMS2h-572-623 (SEQ ID NO: 266)
EVQLLESGGG LVQPGGSLRL SCAASGFTFN WQLMGWVRQA
PGKGLEWVSG IEGPGDVTYY ADSVKGRFTI SRDNSKNTLY
LQMNSLRAED TAVYYCVKVG KESS------ SDYRGQGTLV TVSS

BMS2h-572-624 (SEQ ID NO: 267)
EVQLLESGGG LVQPGGSLRL SCAASGFTFN WQLMGWVRQA
PGKGLEWVSG IEGPGDVTYY ADSVKGRFTI FRDNSKNTLY
LQMNSLRAED TAVYYCVKVG KDSA------ SDYRGQGTLV TVSS

BMS2h-572-625 (SEQ ID NO: 268)
EVQLLESGGG LVQPGGSLRL SCAASGFTFN WQLMGWVRQA
PGKGLEWVSG IEGPGDVTYY ADSVKGRFTI SRDNSKNTLY
LQMNSLRAED TAVYYCVKVG NDSY------ SDYRGQGTLV TVSS

BMS2h-572-626 (SEQ ID NO: 269)
EVQLLESGGG LVQPGGSLRL SCAASGFTFN WQLMGWVRQA
PGKGLEWVSG IEGPGDVTYY ADSVKGRFTI SRDNSKNTLY
LQMNGLRAED TAVYYCVKVG KDSS------ SDYRGQGTLV TVSS

BMS2h-572-627 (SEQ ID NO: 270)
EVQLLESGGG LVQPGGSLRL SCAASGFTFN WQLMGWVRQA
PGKGLEWVSG IEGPGDVTYY ADSVKGRFTI SRDNSKNTLY
LQMNSLRAED TAIYYCVKVG KDSA------ SDYRGQGTLV TVSS

BMS2h-572-630 (SEQ ID NO: 271)
EVQLLESGGG LVQPGGSLRL SCAASGFTFK WQLMGWVRQA
PGKGLEWVSG IEGPGDVTYY ADSVKGRFTI SRDNSKNTLY
LQMNSLRAED TAVYYCVKVG KDAK------ SDYRGQGTLV TVSS

BMS2h-572-631 (SEQ ID NO: 272)
EVQLLESGGG LVQPGGSLRL SCAASGFTFK WQLMGWVRQA
PGKGLEWVSG IEGPGDVTYY ADSVKGRFTI SRDNSKNTLY
LQMNSLRAED TAVYYCVKVG KDSR------ SDYRGQGTLV TVSS

BMS2h-572-632 (SEQ ID NO: 273)
EVQLLESGGG LVQPGGSLRL SCAASGFTFK WQLMGWVRQA
PGKGLEWVSG IEGPGDVTYY ADSVKGRFTI SRDNSKNTLY
LQMNSLRAED TAVYYCVKVG KDSK------ SDYRGQGTLV TVSS

BMS2h-572-633 (SEQ ID NO: 274)
EVQLLESGGG LVQPGGSLRL SCAASGFTFN WELMGWARQA
PGKGLEWVSG IEGPGDVTYY ADSVKGRFTI SRDNSKNTLY
LQMNSLRAED TAVYYCVKVG KDAK------ SDYRGQGTLV TVSS

BMS2h-572-634 (SEQ ID NO: 275)
EVQLLESGGG LVQPGGSLRL SCAASGFTFN WELMGWARQA
PGKGLEWVSG IEGPGDVTYY ADSVKGRFTI SRDNSKNTLY
LQMNSLRAED TAVYYCVKVG KDSR------ SDYRGQGTLV TVSS

BMS2h-572-635 (SEQ ID NO: 276)
EVQLLESGGG LVQPGGSLRL SCAASGFTFN WELMGWARQA
PGKGLEWVSG IEGPGDVTYY ADSVKGRFTI SRDNSKNTLY
LQMNSLRAED TAVYYCVKVG KDSK------ SDYRGQGTLV TVSS

BMS2h-572-7 (SEQ ID NO: 277)
EVQLLESGGG LVQPGGSLRL SCAASGFTFN WQLMGWARQA
PGKGLEWVSG IEGPGDVTYY ADSVKGRFTI SRDNSKNTLY
LQMNSLRAED SAVYYCAKVG KESN------ FDYLGQGTLV TVSS

BMS2h-572-8 (SEQ ID NO: 278)
EVQLLESGGG LVQPGGSLRL SCVASGFTFN WQLMGWVRQA
PGKGLEWVSG IEGPGDVTYY ADSVKGRFTI SRDNSKNTLY
LQMNSLRAED TAVYYCAKVG KESN------ SDYRGQGTLV TVSS

BMS2h-572-9 (SEQ ID NO: 279)
EVQLLESGGG LVQPGGSLRL SCAASGFTFN WQLMGWVRQA
PGKGLEWVSG IEGPGDVTYY ADSVKGRFTI SRDNSKNTLY
LQMNSLRAED TAVYYCAKVG KESN------ SDYRGQGTLV TVSS

BMS2h-573 (SEQ ID NO: 280)
EVQLLESGGG LVQPGGSLRL SCAASGFTFS GWEMGWVRQA
PGKGLEWVSS IDESGLNTYY ADSVKGRFTI SRDNSKNTLY
LQMNSLRAED TAVYYCAEGA PQYQIT---- FDYWGQGTLV TVSS

BMS2h-574 (SEQ ID NO: 281)
EVQLLESGGG LVQPGGSLRL SCAASGFTFP NYGMYWVRQA
PGKGLEWVSY ISRRGLLTYY ADSVKGRFTI SRDNSKNTLY
LQMNSLRAED TAVYYCAKTS HYMNNG---- FDYWGQGTLV TVSS

BMS2h-575 (SEQ ID NO: 282)
EVQLLESGGG LVQPGGSLRL SCAASGFTFV DYTMAWVRQA

TABLE 1-continued

Anti-human CD40L VH Domain Amino Acid Sequences

PGKGLEWVSS ISPIGTFTYY ADSVKGRFTI SRDNSKNTLY
LQMNSLRAED TAVYYCAKDP YGMEDGLTW- FDYWGQGTLV TVSS

BMS2h-576 (SEQ ID NO: 283)
EVQLLESGGG LVQPGGSLRL SCAASGFTFD AYDMQWVRQA
PGKGLEWVST ITSEGLSTYY ADSVKGRFTI SRDNSKNTLY
LQMNSLRAED TAVYYCAKPS DL-------- FDYWGQGTLV TVSS

BMS2h-577 (SEQ ID NO: 284)
EVQLLESGGG LVQPGGSLRL SCAASGFTFD GYDMGWVRQA
PGKGLEWVST ISRGGWFTYY ADSVKGRFTI SRDNSKNTLY
LQMNSLRAED TAVYYCAKGT SQSSTGS--- FDYWGQGTLV TVSS

BMS2h-578 (SEQ ID NO: 285)
EVQLLESGGG LVQPGGSLRL SCAASGFTFR RYDMLWARQA
PGKGLEWVSE ISPTGALTYY ADSVKGRFTI SRDNSKNTLY
LQMNSLRAED TAVYYCAKLG ST-------- FDYWGQGTLV TVSS

BMS2h-579 (SEQ ID NO: 286)
EVQLLESGGG LVQPGGSLRL SCAASGFTFF PYYMSWVRQA
PGKGLEWVSS ISGTGGLTYY ADSVKGRFTI SRDNSKNTLY
LQMNSLRAED TAVYYCAKTT QNATL----- FDYWGQGTLV TVSS

BMS2h-58 (SEQ ID NO: 287)
EVQLLESGGG LVQPGGSLRL SCAASGFTFE VYTMAWVRQA
PGKGLEWVST IDESGRDTYY ADSVKGRFTI SRDNSKNTLY
LQMNSLRAED TAVYYCAKPG VW-------- FDYWGQGTLV TVSS

BMS2h-580 (SEQ ID NO: 288)
EVQLLESGGG LVQPGGSLRL SCAASGFTFA FYKMGWVRQA
PGKGLEWVST ITPKGHHTYY ADSVKGRFTI SRDNSKNTLY
LQMNSLRAED TAVYYCAKVF KGKGWTRPSG FDYWGQGTLV TVSS

BMS2h-581 (SEQ ID NO: 289)
EVQLLESGGG LVQPGGSLRL SCAASGFTFN EYSMMWVRQA
PGKGLEWVSS IGRRGWLTYY ADSVKGRFTI SRDNSKNTLY
LQMNSLRAED TAVYYCAKAV LLDSTK---- FDYWGQGTLV TVSS

BMS2h-582 (SEQ ID NO: 290)
EVQLLESGGG LVQPGGSLRL SCAASGFTFD EYPMTWVRQA
PGKGLEWVST ISARGPFTYY ADSVKGRFTI SRDNSKNTLY
LQMNSLRAED TAVYYCAKGR HWLRNGR--- FDYWGQGTLV TVSS

BMS2h-583 (SEQ ID NO: 291)
EVQLLESGGG LVQPGGSLRL SCAASGFTFG MQSMQWVRQA
PGKGLEWVSS ITDDGTSTYY ADSVKGRFTI SRDNSKNTLY
LQMNSLRAED TAVYYCAKPD RV-------- FDYWGQGTLV TVSS

BMS2h-584 (SEQ ID NO: 292)
EVQLLESGGG LVQPGGSLRL SCAASGFTFG AADMQWVRQA
PGKGLEWVSL ITNDGISTYY ADSVKGRFTI SRDNSKNTLY
LQMNSLRAED TAVYYCAKAG DR-------- FDYWGQGTLV TVSS

BMS2h-586 (SEQ ID NO: 293)
EVQLLESGGG LVQPGGSLRL SCAASGFTFN KYRMQWVRQA
PGKGLEWVSS IDSSGELTYY ADSVKGRFTI SRDNSKNTLY
LQMNSLRAED TAVYYCAEEV PMGNQTF--- FDYWGQGTLV TVSS

BMS2h-587 (SEQ ID NO: 294)
EVQLLESGGG LVQPGGSLRL SCAASGFTFT DYTMGWVRQA
PGKGLEWVSS ITSQGAFTYY ADSVKGRFTI SRDNSKNTLY
LQMNSLRAED TAVYYCAKAT GTDSS----- FDYWGQGTLV TVSS

BMS2h-588 (SEQ ID NO: 295)
EVQLLESGGG LVQPGGSLRL SCAASGFTFE DYEMSWVRQA
PGKGLEWVSC IGPGGKPTYY ADSVKGRFTI SRDNSKNTLY
LQMNSLRAED TAVYYCAKVD GH-------- FDYWGQGTLV TVSS

BMS2h-589 (SEQ ID NO: 296)
EVQLLESGGG LVQPGGSLRL SCAASGFTFS QYDMGWVRQA
PGKGLEWVST ISSRGWLTYY ADSVKGRFTI SRDNSKNTLY
LQMNSLRAED TAVYYCAKGP GGRRR----- FDYWGQGTLV TVSS

BMS2h-59 (SEQ ID NO: 297)
EVQLLESGGG LVQPGGSLRL SCAASGFTFL DYAMGWVRQA
PGKGLEWVST ISPMGMGTYY ADSVKGRFTI SRDNSKNTLY
LQMNSLRAED TAVYYCAKSS AISFTSDISN FDYWGQGTLV TVSS

TABLE 1-continued

Anti-human CD40L VH Domain Amino Acid Sequences

BMS2h-590 (SEQ ID NO: 298)
EVQLLESGGG LVQPGGSLRL SCAASGFTFS DYPMSWVRQA
PGKGLEWVSS ISWSGFQTYY ADSVKGRFTI SRDNSKNTLY
LQMNSLRAED TAVYYCAKPG VARMPTGIA- FDYWGQGTLV TVSS

BMS2h-591 (SEQ ID NO: 299)
EVQLLESGGG LVQPGGSLRL SCAASGFTFS AYEMQWVRQA
PGKGLEWVSS IDSAGTFTYY ADSVKGRFTI SRDNSKNTLY
LQMNSLRAED TAVYYCAEPF GM-------- FDYWGQGTLV TVSS

BMS2h-592 (SEQ ID NO: 300)
EVQLLESGGG LVQPGGSLRL SCAASGFTFS EYPMKWVRQA
PGKGLEWVST IDRQGDRTYY ADSVKGRFTI SRDNSKNTLY
LQMNSLRAED TAVYYCAKTV RRGLPRPSRY FDYWGQGTLV TVSS

BMS2h-593 (SEQ ID NO: 301)
EVQLLESGGG LVQPGGSLRL SCAASGFTFS DYDMGWVRQA
PGKGLEWVSS ISPMGTFTYY ADSVKGRFTI SRDNSKNTLY
LQMNSLRAED TAVYYCAKGL SVYSGLD--- FDYWGQGTLV TVSS

BMS2h-594 (SEQ ID NO: 302)
EVQLLESGGG LVQPGGSLRL SCAASGFTFS HYDMGWVRQA
PGKGLEWVSD IDYIGKTTYY ADSVKGRFTI SRDNSKNTLY
LQMNSLRAED TAVYYCAKAS DEVGVNTSK- FDYWGQGTLV TVSS

BMS2h-595 (SEQ ID NO: 303)
EVQLLESGGG LVQPGGSLRL SCAASGFTFA RYDMGWVRQA
PGKGLEWVST ISPTGVLTYY ADSVKGRFTI SRDNSKNTLY
LQMNSLRAED TAVYYCAKGF ED-------- FDYWGQGTLV TVSS

BMS2h-596 (SEQ ID NO: 304)
EVQLLESGGG LVQPGGSLRL SCAASGFTFE AYPMSWVRQA
PGKGLEWVSL ISHTGHATYY ADSVKGRFTI SRDNSKNTLY
LQMNSLRAED TAVYYCAKGH WP-------- FDYRGQGTLI TVSS

BMS2h-597 (SEQ ID NO: 305)
EVQLLESGGG LVQPGGSLRL SCAASGFTFE DEWMSWVRQA
PGKGLEWVSD ISPGGWTTYY ADSVKGRFTI SRDNSKNTLY
LQMNSLRAED TAVYYCAKGY RPFDE----- FDYWGQGTLV TVSS

BMS2h-598 (SEQ ID NO: 306)
EVQLLESGGG LVQPGGSLRL SCAASGVTFD AIEMSWVRQA
PGKGLEWVSS ISRHGEYTYY ADSVKGRFTI SRDNSKNTLY
LQMNSLRAED TAVYYCAEDA WSRH------ FDYWGQGTLV TVSS

BMS2h-599 (SEQ ID NO: 307)
EVQLLESGGG LVQPGGSLRL SCAASGFTFD STDMSWVRQA
PGKGLEWVSG ILDNGSNTYY ADSVKGRFTI SRDNSKNMLY
LQMNSLRAED TAVYYCAKGA RD-------- FDYWGQGTLV TVSS

BMS2h-600 (SEQ ID NO: 308)
EVQLLESGGG LVQPGGSLRL SCAASGFTFG RQSMQWVRQA
PGKGLEWVSS IDDDGFSTYY ADSVKGRFTI SRDNSKNTLY
LQMNSLRAED TAVYYCAKGD PWG------- FDYWGQGTLV TVSS

BMS2h-601 (SEQ ID NO: 309)
EVQLLESGGG LVQPGGSLRL SCTASGFTFS DTQMAWVRQA
PGKGLEWVSG IDDGGVSTYY ADSVKGRFTI SRDNSKNTLY
LQMNSLRAED TAVYYCAKPD RH-------- FDYWGQGTLV TVSS

BMS2h-602 (SEQ ID NO: 310)
EVQLLESGGG LVQPGGSLRL SCAASGFTFG STTMGWVRQA
PGKGLEWVSV ISDDGGFTYY ADSVKGRFTI SRDNSRNTLY
LQMNSLRAED TAVYYCAKVD GYGV------ FDYWGQGTLV TVSS

BMS2h-603 (SEQ ID NO: 311)
EVQLLESGGG LVQPGGSLRL SCAASGFTFR SGDMNWVRQA
PGKGLEWVST ITNDGTSTYY ADSVKGRFTI SRDNSKNTLY
LQMNSLRAED TAVYYCAKSD SD-------- FDYWGQGTLV TVSS

BMS2h-61 (SEQ ID NO: 312)
EVQLLESGGG LVQPGGSLRL SCAASGFTFA AYAMTWVRQA
PGKGLEWVSY ISPNGTATYY ADSVKGRFTI SRDNSKNTLY
LQMNSLRAED TAVYYCAEYV GMRWNS---- FDYWGQGTLV TVSS

BMS2h-62 (SEQ ID NO: 313)
EVQLLESGGG LVQPGGSLRL SCAASGFTFS SYEMAWVRQA

TABLE 1-continued

Anti-human CD40L VH Domain Amino Acid Sequences

PGKGLEWVSS ITSLGTSTYY ADSVKGRFTI SRDNSKNTLY
LQMNSLRAED TAVYYCAKPG RK-------- FDYWGQGTLV TVSS

BMS2h-65 (SEQ ID NO: 314)
EVQLLESGGG LVQPGGSLRL SCAASGFTFN EYEMTWVRQA
PGKGLEWVST ITSEGSGTYY ADSVKGRFTI SRDNSKNTLY
LQMNSLRAED TAVYYCAKPN GK-------- FDYWGQGTLV TVSS

BMS2h-66 (SEQ ID NO: 315)
EVQLLESGGG LVQPGGSLRL SCAASGFTFS DYEMLWVRQA
PGKGLEWVST ITSEGHSTYY ADSVKGRFTI SRDNSKNTLY
LQMNSLRAED TAVYYCAKPG TS-------- FDYWGQGTLV TVSS

BMS2h-67 (SEQ ID NO: 316)
EVQLLESGGG LVQPGGSLRL SCAASGFTFS DYEMSWVRQA
PGKGLEWVST IDSDGSFTYY ADSVKGRFTI SRDNSKNTLY
LQMNSLRAED TAVYYCAKPG VK-------- FDYWGQGTLV TVSS

BMS2h-68 (SEQ ID NO: 317)
EVQLLESGGG LVQPGGSLRL SCAASGFTFK DYEMTWVRQA
PGKGLEWVSS ISSTGQSTYY ADSVKGRFTI SRDNSKNTLY
LQMNSLRAED TAVYYCAKPG NK-------- FDYWGQGTLV TVSS

BMS2h-69 (SEQ ID NO: 318)
EVQLLESGGG LVQPGGSLRL SCAASGFTFL DYGMAWVRQA
PGKGLEWVSA ISPLGLSTYY ADSVKSRFTI SRDNSKNTLY
LQMNSLRAED TAVYYCAKEV RVGRGVHPPK FDYWGQGTLV TVSS

BMS2h-7 (SEQ ID NO: 319)
EVQLLESGGG LVQPGGSLRL SCAASGFTFN LYEMTWVRQA
PGKGLEWVSS ITSDGVSTYY ADSVKGRFTI SRDNSKNTLY
LQMNSLRAED TAVYYCAKAG VI-------- FDYWGQGTLV TVSS

BMS2h-70 (SEQ ID NO: 320)
EVQLLESGGG LVQPGGSLRL SCAASGFTFE NYAMSWVRQA
PGKGLEWVST IAPLGVPTYY ADSVKGRFTI SRDNSKNTLY
LQMNSLRAED TAVYYCAKKK VGAWLQSRS- FDYWGQGTLV TVSS

BMS2h-701 (SEQ ID NO: 321)
EVQLLESGGG LVQPGGSLRL SCAASGFTFM DYEMHWVRQA
PGKGLEWVST IGASGHYTYY ADSVKGRFTI SRDNSKNTLY
LQMNSLRAED TAVYYCAKYL DMLLFG---- FDYWGQGTLV TVSS

BMS2h-702 (SEQ ID NO: 322)
EVQLLESGGG LVQPGGSLRL SCAASGFTFA EYEMMWARQA
PGKGLEWVSR IAGNGSRTYY ADSVKGRFTI SRDNSKNTLY
LQMNSLRAED TAVYYCAIML SH-------- FDYWGQGTLV TVSS

BMS2h-703 (SEQ ID NO: 323)
EVQLLESGGG LVQPGGSLRL SCAASGFTFY NYDMSWVRQA
PGKGLEWVSG IDSMGLVTYY ADSVKGRFTI SRDNSKNTLY
LQMNSLRAED TAVYYCAKGS NASDWVV--- FDYWGQGTLV TVSS

BMS2h-704 (SEQ ID NO: 324)
EVQLLESGGG LVQPGGSLRL SCAASGFTFA SYHMTWVRQA
PGKGLEWVSS IADTGDRTYY ADSVKGRFTI SRDNSKNTLY
LQMNSLRAED TAVYYCAKLR GMARVWG--- FDYWGQGTLV TVSS

BMS2h-705 (SEQ ID NO: 325)
EVQLLESGGG LVQPGGSLRL SCAASGFTFS YYDMMWVRQA
PGKGLEWISS ISDRGLQTYY ADSVKGRFTI SRDNSKNTLY
LQMNSLRAED TAVYYCAKFT EIPLDWLEV- FDYWGQGTLV TVSS

BMS2h-706 (SEQ ID NO: 326)
EVQLLESGGG LVQPGGSLRL SCAASGFTFG SYKMLWVRQA
PGKGLEWVSS ITNSGTETYY ADSVKGRFTI SRDNSKNTLY
LQMNSLRAED TAVYYCAKSM YPDLEIVH-FDYWGQGTLV TVSS

BMS2h-707 (SEQ ID NO: 327)
EVQLLESGGG LVQPGGSLRL SCAASGFTFE TYRMSWVRQA
PGKGLEWVSA IDQEGSATYY ADSVKGRFTI SRDNSKNTLY
LQMNSLRAED TAVYYCAKNS GTRPGLR--- FDYWGQGTLV TVSS

BMS2h-708 (SEQ ID NO: 328)
EVQLLESGGG LVQPGGSLRL SCAASGFTFS SYDMLWVRQA
PGKGLEWVSR IDASGYFTYY ADSVKGRFTI SRDNSKNTLY
LQMNSLRAED TAVYYCAQLL KLSLNPN--- FDYWGQGTLV TVSS

BMS2h-709 (SEQ ID NO: 329)
EVQLLESGGG LVQPGGSLRL SCAASGFTFS SYAMSWVRQA
PGKGLEWVSS IHNTGLSTYY ADSVKGRFTI SRDNSKNTLY
LQMNSLRAED TAVYYCAKGT QHRFVV---- FDYWGQGTLV TVSS

BMS2h-71 (SEQ ID NO: 330)
EVQLLESGGG LVQPGGSLRL SCAASGFTFE GYPMSWVRQA
PGKGLEWVST ISPLGPDTYY ADSVKGRFTI SRDNSKNTLY
LQMNSLRAED TAVYYCAKLL MGEYLNSRT- FDYWGQGTLV TVSS

BMS2h-710 (SEQ ID NO: 331)
EVQLLESGGG LVQPGGSLRL SCAASGFTFN TYSMSWVRQA
PGKGLEWVSW IDADGWVTYY ADSVKGRFTI SRDNSKNTLY
LQMNSLRAED TAVYYCAQTG HT-------- FDYWGQGTLV TVSS

BMS2h-711 (SEQ ID NO: 332)
EVQLLESGGG LVQPGGSLRL SCAASGFTFT DGEMGWARQA
PGKGLEWVSR IVDPGDSTYY ADSVKGRFTI SRDNSKNTLY
LQMNSLRAED TAVYYCAKAG DQ-------- FDYWGQGTLV TVSS

BMS2h-712 (SEQ ID NO: 333)
EVQLLESGGG LVQPGGSLRL SCAASGFTFP EYEMKWVRQA
PGKGLEWVST ITPSGGHTYY ADSVKGRFTI SRDNSKNTLY
LQMNSLRAED AAVYYCAIPL SS-------- FDYWGRGTLV TVSS

BMS2h-713 (SEQ ID NO: 334)
EVQLLESGGG LVQPGGSLRL SCAASGFTFS NYVMIWVRQA
PGKGLEWVSL INGAGDMTYY ADSVKGRFTI SRDNSKNTLY
LQMNSLRAED TAVYYCAEGG ARSFGVPPN- FDYWGQGTLV TVSS

BMS2h-714 (SEQ ID NO: 335)
EVQLLESGGG LVQPGGSLRL SCAASGFTFT DGEMGWARQA
PGKGLEWVSR IVDPGDSTYY ADSVKGRFTI SRDNSKNTLY
LQMNSLRAED TAVYYCAKAG DQ-------- FDYWGQGTLV TVSS

BMS2h-715 (SEQ ID NO: 336)
EVQLLESGGG LVQPGGSLRL SCVASGFTFT LYNMSWVRQA
PGKGLEWVSV ISSKGDSTYY ADSVKGRFTI SRDNSKNTLY
LQMNSLRAED TAVYYCAQTS SV-------- FDYWGQGTLV TVSS

BMS2h-716 (SEQ ID NO: 337)
EVQLLESGGG LVQPGGSLRL SCAASGFTFE AYYMSWVRQA
PGKGLEWVSG IVNNGLLTYY ADSVKGRFTI SRDNSKNMLY
LQMNSLRAED TAVYYCAKSA VHPSYRAEL- FDYWGQGTLV TVSS

BMS2h-717 (SEQ ID NO: 338)
EVQLLESGGG LVQPGGSLRL SCAASGFTFS SYEMAWVRQA
PGKGLEWVSR IEPDGSNTYY ADSVKGRFTI SRDNSKNTLY
LQMNSLRAED TAVYYCAKGP DNFTM----- FDYWGQGTLV TVSS

BMS2h-718 (SEQ ID NO: 339)
EVQLLESGGG LVQPGGSLRL SCAASGFTFN KYMMGWVRQA
PGKGLEWVSS IDSLGHYTYY ADSVKGRFTI SRDNSKNTLY
LQMNSLRAED TAVYYCAEAE FP-------- FDYWGQGTLV TVSS

BMS2h-719 (SEQ ID NO: 340)
EVQLLESGGG LVQPGGSLRL SCAASGFTFK RYEMTWVRQA
PGKGLEWVSS ISSDGSFTYY ADSVKGRFTI SRDNSKNTLY
LQMNSLRAED TAVYYCAEPF TE-------- FDYWGQGTLV TVSS

BMS2h-719-1 (SEQ ID NO: 341)
EVQLLESGGG MVQPGGSLRL SCAASGFTFK RYEMMWVRQA
PGKGLEWVSS ISSDGSFTYY ADSVKGRFTI SRDNSKNTLY
LQMNSLRAED TAVYYCAEPF TE-------- FDYWGQGTQV TVSS

BMS2h-719-10 (SEQ ID NO: 342)
EVQLLESGGG MVQPGGSLRL SCAASGFTFK RYEMMWVRQA
PGKGLEWVSS ISSDGSFTYY ADSVKGRFTI SRDNSKNTLY
LQMNSLRAED TAVYYCAEPF TE-------- FDYWGQGTLV TVSS

BMS2h-719-11 (SEQ ID NO: 343)
EVQLLESGGG LVQPGGSLRL SCAASGFTFK RYEMMWVRKA
PGKGLEWVSS ISSDGSFTYY ADSVKGRFTI SRDNSENTLY
LQMNSLRAED TAVYYCADPF TE-------- FDYWGQGTLV TVSS

BMS2h-719-12 (SEQ ID NO: 344)
EVQLLESGGG LVQPGGSLRL SCAASGFTFK RYEMMWVRQA

TABLE 1-continued

Anti-human CD40L VH Domain Amino Acid Sequences

PGKGLEWVSS ISSDGSFTYY ADSVKGRFTV SRDNSKNTLY
LQMNSLRAED TAVYYCADPF TE-------- FDYWGQGTLV TVSS

BMS2h-719-13 (SEQ ID NO: 345)
EVQLLESGGG LVQPGGSLRL SCAASGFTFK RYEMMWVRQA
PGKGLEWVSS ISSDGSFTYY ADSVKGRFTI SRDNTKNTLY
LQMNSLRAED TAVYYCADPF TE-------- LDYWGHGTLV TVSS

BMS2h-719-14 (SEQ ID NO: 346)
EVQLLESGGG LVRPGGSLRL SCAASGFTFK RYEMMWVRQA
PGKGLEWVSS ISSDGSFTYY ADSVKGRFTI SRDNSKNTLY
LQMNSLRAED TAVYFCADPF TE-------- FDYWGHGTLV TVSS

BMS2h-719-15 (SEQ ID NO: 347)
EVQLLESGGG LVQPGGSLRL SCAASGFAFK RYEMTWVRQA
PGKGLEWVSS ISSDGSFTYY ADSVKGRFTI SRDNSKNTLY
LHMNSLRAED TAVYYCADPF TE-------- IDYWGQGTLV TVSS

BMS2h-719-16 (SEQ ID NO: 348)
EVQLLESGGG LVQPGGSLRL SCAASGFPFK RYEMTWVRQA
PGKGLEWVSS ISSDGSFTYY ADSVKGRFTI SRDNSKNTLY
LQMNSLRAED TAVYYCAEPF TE-------- FDYRAQGTLV TVSS

BMS2h-719-17 (SEQ ID NO: 349)
EVQLLESGGG LVQPGGSLRL SCAASGFTFK RYEMSWVRQA
PGKGLEWVSS ISSDGSFTYY ADSVKGRFTI SRDNSKNTLY
LQMNSLRAED TAVYYCADPF TE-------- IDYWGQGTQV TVSS

BMS2h-719-18 (SEQ ID NO: 350)
EVQLLESGGG LVHPGGSLRL SCAASGFTFK RYEMMWVRQA
PGKGLEWVSS ISSDGSFTYY ADSVKGRFTI SRDNSKNTLY
LQMNSLRDED TAVYYCAEPF TE-------- FDYGGQGTLV TVSS

BMS2h-719-19 (SEQ ID NO: 351)
EVQLLESGGG WVQPGGSLRL SCAASGFTFK RYEMMWVRQA
PGKGLEWVSS ISSDGSFTYY ADSVKGRFTI SRDNSKNTLY
LQMNSLRAED TAVYYCADPF TE-------- FDYWGQGTLV TVSS

BMS2h-719-2 (SEQ ID NO: 352)
EVQLLESGGG LVQPGGSLRL SCAASGFTFK RYEMMWVRQA
PGKGLEWVSS ISSDGSFTYY ADSVKGRFTI SRDNSKNTLY
LQMNSLRAED TAVYYCAEPF TE-------- FDYWGHGTLV TVSS

BMS2h-719-20 (SEQ ID NO: 353)
EVQLLESGGG LVQPGGSLRL SCAASGFTFK RYEMTWVRQA
PGKGLEWVSS ISSDGSFTYY ADSVKGRFTI SRDNSKNTLY
LQMNSLRAED TAVYYCAEPF TE-------- IDYRGQGTLV TVSS

BMS2h-719-202 (SEQ ID NO: 354)
EVQLLESGGG LVQPGGSLRL SCAASGFTFK KYEMMWVRQA
PGKGLEWVSS ISSDGSFTYY ADSVKGRFTI SRDNSKNTLY
LQMNSLRAED TAVYYCAEPF TE-------- FDYWGHGTLV TVSS

BMS2h-719-203 (SEQ ID NO: 355)
EVQLLESGGG LVQPGGSLRL SCAASGFTFN SYEMMWVRQA
PGKGLEWVSS ISSDGSFTYY ADSVKGRFTI SRDNSKNTLY
LQMNSLRAED TAVYYCAEPF TE-------- FDYWGHGTLV TVSS

BMS2h-719-21 (SEQ ID NO: 356)
EVQLLESGGG LVQPGGSLRL SCAASGFTFK RYEMMWVRQA
PGKGLEWVSS ISSDGSFTYY ADSVKGRFTI SRDNSKNTLY
LQMNSLRAED TAVYYCADPF TE-------- FDYWGQGTLV TVSS

BMS2h-719-213 (SEQ ID NO: 357)
EVQLLESGGG LVQPGGSLRL SCAASGFTFK RYEMMWVRQA
PGKGLEWVSS ISSDGSFTYY ADSVKGRFTI SRDNSKNTLY
LQMNSLRAED TAVYYCADPF TE-------- MDYWGHGTLV TVSS

BMS2h-719-214 (SEQ ID NO: 358)
EVQLLESGGG LVQPGGSLRL SCAASGFTFK RYEMMWVRQA
PGKGLEWVSS ISSDGSFTYY ADSVKGRFTI SRDNSKNTLY
LQMNSLRAED TAVYYCADPF TE-------- FDYWGHGTLV TVSS

BMS2h-719-215 (SEQ ID NO: 359)
EVQLLESGGG LVQPGGSLRL SCAASGFTFK RYEMMWVRQA
PGKGLEWVSS ISSDGSFTYY ADSVKGRFTI SRDNSKNTLY
LQMNSLRAED TAVYYCAEPF TE-------- LDYWGHGTLV TVSS

BMS2h-719-218 (SEQ ID NO: 360)
EVQLLESGGG LVQPGGSLRL SCAASGFTFK RYEMMWVRQA
PGKGLEWVSS ISSDGSFTYY AESVKGRFTI SRDNSKNTLY
LQMNSLRAED TAVYYCAEPF TE-------- FDYWGHGTLV TVSS

BMS2h-719-225 (SEQ ID NO: 361)
EVQLLESGGG LVQPGGSLRL SCAASGFTFN TYEMQWVRQA
PGKGLEWVSS ISSDGSFTYY ADSVKGRFTI SRDNSKNTLY
LQMNSLRAED TAVYYCAEPF TE-------- FDYWGHGTLV TVSS

BMS2h-719-226 (SEQ ID NO: 362)
EVQLLESGGG LVQPGGSLRL SCAASGFTFN KYEMMWARQA
PGKGLEWVSS ISSDGSFTYY ADSVKGRFTI SRDNSRNTLY
LQMNSLRAED TAVYYCAEPF TE-------- FDYWGHGTLV TVSS

BMS2h-719-3 (SEQ ID NO: 363)
EVQLSESGGG LVQPGGSLRL SCAASGFTFK RYEMMWVRQA
PGKGLEWVSS ISSDGSFTYY ADSVKGRFTI SRDNSKNTLY
LQMNSLRAED TAVYYCADPF TE-------- FDYWGQGTLV TVSS

BMS2h-719-4 (SEQ ID NO: 364)
EVQLLESGGG LVQPGGSLRL SCAASGFTFK RYEMMWVRQT
PGKGLEWVSS ISSDGSFTYY ADSVKGRFTI SRDNSKNTLY
LQMNSLRAED TAVYYCAEPF TE-------- FDYWGQGTLV TVSS

BMS2h-719-5 (SEQ ID NO: 365)
EVQLLESGGG LVQPGGSLRL SCAASGFTFK RYEMMWVRQA
PGKGLEWVSS ISSDGSFTYY ADSVKGRFTI SRDNSKNTLY
LEMNSMRAED TAVYYCAEPF TE-------- FDNWGQGTLV TVSS

BMS2h-719-6 (SEQ ID NO: 366)
EVQLLESGGG LVQPGGSLRL SCAASGFTFK RYEMMWVRQA
PGKGLEWVSS ISSDGSFTYY ADSVKGRFTI SRDNSKNTLY
LQMNSLRAED TAVYYCAEPF TE-------- FDYWGQGTQV TVSS

BMS2h-719-7 (SEQ ID NO: 367)
EVQLLESGGG LVQPGGSLRL SCAASGFNFK RYEMTWVRQA
PGKGLEWVSS ISSDGSFTYY ADSVKGRFTI SRDNSKNTLY
LQMNSLRAED TAVYYCADPF TE-------- FDYWGQGTLV TVSS

BMS2h-719-8 (SEQ ID NO: 368)
EVQLLESGGD LVQPGGSLRL SCAASGFTFK RYEMMWVRQA
PGKGLEWVSS ISSDGSFTYY ADSVKGRFTI SRDNSKNTLY
LQMNSLRAED TAVYYCAEPF TE-------- FDYRGQGTLV TVSS

BMS2h-719-9 (SEQ ID NO: 369)
EVQLLESGGG LVQPGGSLRL SCAASGFTFK RYEMSWVRQA
PGKGLEWVSS ISSDGSFTYY ADSVKGRFTI SRDNSKNTLY
LQMNSLRAED TAVYYCAEPF TE-------- FDYWGRGTLV TVSS

BMS2h-72 (SEQ ID NO: 370)
EVQLLESGGG LVQPGGSLRL SCAASGFTFE AYPMSWVRQA
PGKGLEWVSS ISPLGLWTYY ADSVKGRFTI SRDNSKNTLY
LQMNSLRAED TAVYYCAKLS AGAETHVYRL FDYWGQGTLV TVSS

BMS2h-720 (SEQ ID NO: 371)
EVQLLESGGG LVQPGGSLRL SCAASGFTFG NYEMMWVRQA
PGKGLEWVSS IGVLGHTTYY ADSVKGRFTI SRDNSKNTLY
LQMNSLRAED TAVYYCAKLM SLRTFENL-FDYWGQGTLV TVSS

BMS2h-722 (SEQ ID NO: 372)
EVQLLESGGG LVQPGGSLRL SCAASGFTFT KYPMAWVRQA
PGKGLEWVSG IDANGNRTYY ADSVKGRFTI SRDNSKNTLY
LQMNSLRAED TAVYYCAEGT WRRHFAI--- FDYWGQGTLV TVSS

BMS2h-723 (SEQ ID NO: 373)
EVQLLESGGG LVQPGGSLRL SCAASGFTFD LYDMMWVRQA
PGKGLEWVSS ISDLGTLTYY ADSVKGRFTI SRDNSKNTLY
LQMNSLRAED TAVYYCAKNG FRVTSNDRR- FDYWGQGTLV TVSS

BMS2h-724 (SEQ ID NO: 374)
EVQLLESGGG LVQPGGSLRL SCAASGFTFT GGDMWVRQA
PGKGLEWVSM IEGGGVTTYY ADSVKGRFTI SRDNSKNTLY
LQMNSLRAED TAVYYCAELD LRTGQ----- FDYWGQGTLV TVSS

BMS2h-725 (SEQ ID NO: 375)
EVQLLESGGG LVQPGGSLRL SCAASGFTFS AYTMGWVRQA

TABLE 1-continued

Anti-human CD40L VH Domain Amino Acid Sequences

PGKGLEWVSL IGDRGSWTYY ADSVKGRFTI SRDNSKNTLY
LQMNSLRAED TAVYYCAEPS DPTK------ FDYWGQGTLV TVSS

BMS2h-725-1 (SEQ ID NO: 376)
EVQLLESGGG LVQPGGSLHL SCAASGFTFS AYTMGWVRQA
PGKGLEWVSL IGDRGSWTYY ADSVKGRFTI SRDNSKNTLY
LQMNSLRAED TAVYFCADPS DPTK------ FDYWGQGTLV TVSS

BMS2h-725-10 (SEQ ID NO: 377)
EVQLLESGGG LVQPGGSLRL SCAASGFTFS AYTMGWVRQA
PGKGLEWVSL IGDRGSWTYY ADSVKGRFTI SRDNSKNTLY
LQMNSLRAED TAVYYCADPS DPTK------ FDYWGQGTLV TVSS

BMS2h-725-11 (SEQ ID NO: 378)
EVQLLESGGG LVQPGGSLRL SCAASGFTFS AYTMGWVRQA
PGKGLEWVSL IGDRGSWTYY ADSVKGRFTI SRDNSKNTLY
LQMSSLRAED TAVYYCADPS DPTK------ FDYWGQGTLV TVSS

BMS2h-725-12 (SEQ ID NO: 379)
EVQLLESGGG LVQPGGSLRL SCAASGFTFP AYTMGWVRQA
PGKGLEWVSL IGDRGSWTYY ADSVKGRFTI SRDDSKNTLY
LQMNSLRVED TAVYYCAEPS DPTM------ FVYWGQGTLV TVSS

BMS2h-725-13 (SEQ ID NO: 380)
EVQLLESGGG LVQPGGSLRL SCAASGFTFS AYTMGWVRQA
PGKGLEWVSL IGDRGSWTYY ADSVKGRFTI SRDNSKNTLY
LQMNSLRAED TAVYYCAEPS DPTM------ FVYWGQGTLV TVSS

BMS2h-725-14 (SEQ ID NO: 381)
EVQLLESGGG LVQPGGSLRL SCAASGFTFS AYTMGWVRQA
PGKGLEWVSL IGDRGSWTYY ADSVKGRFTI SRDNSKNTLY
LQMNSLRAED TAVYYCADPS DPTM------ FDYWGQGTLV TVSS

BMS2h-725-15 (SEQ ID NO: 382)
EVQLLESGGG MVQPGGSLRL SCAASGFTFS AYTMGWVRQA
PGKGLEWVSL IGDRGSWTYY ADSVKGRFTI SRDNSKNTLY
LQMNSMRAED TAVYYCADPS DPTK------ FDYWGQGTLV TVSS

BMS2h-725-16 (SEQ ID NO: 383)
EVQLLESGGG LVQPGGSLRL SCAASGFTFS AYTMGWVRQA
PGKGLEWVTL IGDRGSWTYY ADSVKGRFTI SRDNSKNTLY
LQMNSLRAED TAVYYCAEPS DPTM------ FDYWGQGTLV TVSS

BMS2h-725-17 (SEQ ID NO: 384)
EVQLLESGGG LVQPGGSLRL SCAASGFTFT AYTMGWVRQA
PGKGLEWVSL IGDRGSWTYY ADSVKGRFTI SRDNSKNTLY
LQMNSLRAED TAVYYCAEPS DPTK------ LDYWGQGTLV TVSS

BMS2h-725-18 (SEQ ID NO: 385)
EVQLSESGGG LVQPGGSLRL TCAASGFTFS AYTMGWVRQA
PGKGLEWVSL IGDRGSWTYY ADSVKGRFTI SRDNSKNTLY
LQMNSLRAED TAVYYCADPS DPTK------ FVYWGQGTLV TVSS

BMS2h-725-19 (SEQ ID NO: 386)
EVQLLESGGG LVQPGGSLRL SCAASGFTFS AYTMGWVRQA
PGKGLEWVSL IGDRGSWTYY ADSVKGRFTI SRDNSKNTLY
LQMNSLRAED TAVYYCAEPS DPTK------ FVYWGQGTLV TVSS

BMS2h-725-2 (SEQ ID NO: 387)
EVQLLESGGG LVQPGGSLRL SCAASGFTFS AYTMGWVRQA
PGKGLEWVSL IGDRGSWTYY ADSVKGRFTI SRDNSKNTLY
LQMNSLRAED TAVYYCAEPS DPTK------ FVYWGQGTPV TVSS

BMS2h-725-3 (SEQ ID NO: 388)
VQLLESGGG LVQPGGSLRL SCAASGFTFS AYTMGWVRQA
PGKGLEWVSL IGDRGSWTYY ADSVKGRFTI SRDNSRNMLY
LQMKSLRAED TAVYYCADPS DPTK------ FVYWGQGTQV TVSS

BMS2h-725-4 (SEQ ID NO: 389)
EVQLLESGGG LVQPGGSLRL SCAASGFTFS AYTMGWVRQA
PGKGLEWVSL IGDRGSWTYY ADSVKGRFTI FRDNSKNTLY
LQMNSLRAED TAVYYCADPS DPTK------ FVYWGQGTLV TVSS

BMS2h-725-5 (SEQ ID NO: 390)
EVQLLESGGG LLQPGGSLRL SCAASGFTFS DYTMGWVRQA
PGKGLEWVSL IGDRGSWTYY ADSVKGRFTI SRDNSKNTLY
LQMNSLRAED TAVYYCAEPS DPTK------ FDYWGRGTLV TVSS

BMS2h-725-6 (SEQ ID NO: 391)
EVQLLESGGG LVQPGGSLRL SCAASGFTFS AYTMGWVRQA
PGKGLEWVSL IGDRGSWTYY ADSVKGRFTI SRDNSKNTLY
LQMNSLRAED TAVYYCAEPS DPTK------ FVYWGQGTLV TVSS

BMS2h-725-7 (SEQ ID NO: 392)
EVQLLESGGG LVQPGGSLRL SCAASGFTFS AYTMGWVRQA
PGKGLEWVSL IGDRGTWTYY ADPVKGRFTI SRDNSKNTLY
LQMNSLRAED TAVYYCADPS DPTK------ FDYWGQGTLV TVSS

BMS2h-725-8 (SEQ ID NO: 393)
EVQLLESGGG LVQPGGSLRL SCAASGFTFS AYTMGWVRQA
PGKGLEWVSL IGDRGSWTYY ADSVKGRFTV SRDNSKNTLY
LQMNSLRAED TAVYYCAEPS DPTK------ FDYWGQGTLV TVSS

BMS2h-725-9 (SEQ ID NO: 394)
EVQLLESGGG LVQPGGSLRL SCAASGFTFS AYTMGWVRQA
PGMGLEWVSL IGDRGSWTYY ADSVKGRFTI SRDNSKNTLY
LQMNSLRAED TAVYYCAEPS DPTK------ FDYWGQGTLV TVSS

BMS2h-726 (SEQ ID NO: 395)
EVQLLESGGG LVQPGGSLRL SCAASGFTFD NYKMYWVRQA
PGKGLEWVSS ISEIGNLTYY ADSVKGRFTI SRDNSKNTLY
LQMNSLRAED TAVYYCAIAL TR-------- FDYWGQGTLV TVSS

BMS2h-727 (SEQ ID NO: 396)
EVQLLESGGG LVQPGGSLRL SCAASGFTFA SYRMYWVRQA
PGKGLEWVSY IDPPGSRTYY ADSVKGRFTI SRDNSKNTLY
LQMNSLRAED TAVYYCAKSL NLSFPYIN-FDYWGQGTLV TVSS

BMS2h-728 (SEQ ID NO: 397)
EVQLLESGGG LVQPGGSLRL SCAASGFTFE RYEMLWVRQA
PGKGLEWVSR ISHSGRTTYY ADSVKGRFTI SRDNSKNTLY
LQMNSLRAED TAVYYCAQLD GP-------- FDYWGQGTLV TVSS

BMS2h-729 (SEQ ID NO: 398)
EVQLLESGGG LVQPGGSLRL SCAASGFTFK RYYMDWVRQA
PGKGLEWVSR INHNGSVTYY ADSVKGRFTI SRDNSKNTLY
LQMNSLRAED TAVYYCAKMP QGTSDWYY-FDYWGQGTLV TVSS

BMS2h-73 (SEQ ID NO: 399)
EVQLLESGGG LVQPGGSLRL SCAASGFTFS KYDMSWVRQA
PGKGLEWVST ILEDGLTTYY ADSVKGRFTI SRDNSKNTLY
LQMNSLRAED TAVYYCAKPG RL-------- FDYWGQGTLV TVSS

BMS2h-74 (SEQ ID NO: 400)
EVQLLESGGG LVQPGGSLRL SCAASGFTFS DYPMTWVRQA
PGKGLEWVST ILSPGTETYY ADSVKGRFTI SRDNSKNTLY
LQMNSLRAED TAVYYCAKAE KD-------- FDYWGQGTLV TVSS

BMS2h-741 (SEQ ID NO: 401)
EVQLLESGGG LVQPGGSLRL SCAASGFTFE GGEMGWVRQA
PGKGLEWVSM IPMDGSATYY ADSVKGRFTI SRDNSKNTLY
LQMNSLRAED TAVYYCAKAG EV-------- FDYWGQGTLV TVSS

BMS2h-742 (SEQ ID NO: 402)
EVQLLESGGG LVQPGGSLRL SCAASGFTFR EYHMKWARQA
PGKGLEWVSG ISRDGMNTYY ADSVKGRFTI SRDNSKNTLY
LQMNSLRAED TAVYYCAIQL AL-------- FDYWGQGTLV TVSS

BMS2h-743 (SEQ ID NO: 403)
EVQLLESGGG LVQPGGSLRL SCAASGFTFR DYEMLWARQA
PGKGLEWVSG ILPSGGATYY ADSVKGRFTI SRDNSKNTLY
LQMNSLRAED TAVYYCAKAG SGNGPIL--- FDYWGQGTLV TVSS

BMS2h-744 (SEQ ID NO: 404)
EVQLLESGGG LVQPGGSLRL SCAASGFTFK EHDMFWVRQA
PGKGLEWVSG IGAEGVWTYY ADSVKGRFTI SRDNSKNTLY
LQMNSLRAED TAVYYCAEPT MSNGSQSR-FDYWGQGTLV TVSS

BMS2h-745 (SEQ ID NO: 405)
EVQLLESGGG LVQPGGSLRL SCAASGFTFD NTEMAWVRQA
PGKGLEWVSG IIEDGNRTYY ADSVKGRFTI SRDNSKNTLY
LQMNSLRAED TAVYYCAKIR NLHWDVGRQ- FDYWGQGTLV TVSS

BMS2h-745-1 (SEQ ID NO: 406)
EVQLLESGGG LVQPGGSLRL SCAASGFTFD NTEMAWVRQA

TABLE 1-continued

Anti-human CD40L VH Domain Amino Acid Sequences

PGKGLEWVSG ITEDGNRTYY ADSVKGRFTI SRDNSKNTLY
LQMNSLRAED TAVYYCAKIR NLHWDVGRQ- FDYWGQGTLV TVSS

BMS2h-745-10 (SEQ ID NO: 407)
EVQLLESGGG LVQPGGSLRL SCAASGFTFD NTEMAWVRQA
PGKGLEWVSG ITEDGNRTYY ADSVKGRFTI SRDNSKNTLY
LQMNNLRAED TAVYYCAKIR NLHWDVGRQ- FDYWGQGTLV TVSS

BMS2h-745-11 (SEQ ID NO: 408)
EVQLLESGGG LVQPGGSLRL SCAASGFTFD NTEMAWIRQA
PGKGLEWVSG ITEDGNRTYY ADSVKGRFTI SRDNFKNTLY
LQMNSLRAED TAVYYCAKIR NLHWDVGRQ- FDYWGQGTLV TVSS

BMS2h-745-12 (SEQ ID NO: 409)
EVQLLESGGG LVQPGGSLRL SCAASGFTFD NTEMAWVRQA
PGKGLEWVSG ITEDGNRTYY ADSVKGRFTI SRDNSMNTLY
LQMNSLRAED TAVYYCAKIR NLHWDVGRQ- FVYWGQGTLV TVSS

BMS2h-745-13 (SEQ ID NO: 410)
EVQLLESGGG LVQPGGSLRL SCAASGFTFD NTEMAWIRQA
PGKGLEWVSG IIEDGNRTYY ADSVKGRFTI SRDNSKNTLY
LQMNSLRAED TAVYYCAKIR NLHWDVGRQ- FDYWGQGTLV TVSS

BMS2h-745-14 (SEQ ID NO: 411)
EVQLLESGGG LVQPGGSLRL SCAASGFTFD NTEMAWVRQA
PGKGLEWVSG ITEDGNRTYY ADSVKGRFTI SRDNSKNTLY
LQMNSLRAED TAVYYCAKIR NLHWDVGRQ- FDYWGQGTLV TVSS

BMS2h-745-15 (SEQ ID NO: 412)
EVQLLESGGG LVQPGGSLRL SCAASGFTFD NTEMAWIRQA
PGKGLEWVSG ITEDGNRTYY ADSVKGRFTI SRDNSKNALY
LQMNSLRAED TAVYYCAKIR NLHWDVGRQ- FDYWGLGTLV TVSS

BMS2h-745-16 (SEQ ID NO: 413)
EVQLLESGGG LVQPGGSLRL SCAASGFTFD NTEMAWVRQA
PGKGLEWVSG ITEDGNRTYY ADSVKGRFTI SRDNTKNTLY
LQMNSLRAED TAVYYCAKIR NLHWDVGRQ- FVYWGQGTLV TVSS

BMS2h-745-17 (SEQ ID NO: 414)
EVQLLESGGG LVQPGGSLRL SCAASGFTFD NTEMAWIRQA
PGKGLEWVSG IIEDGNRTYY ADSVKGRFTI SRDNSKNRLY
LQMNSLRAED TAVYYCAKIR NLHWDVGRQ- FDYWGQGTLV TVSS

BMS2h-745-18 (SEQ ID NO: 415)
EVQLLESGGG LVQPGGSLRL SCAASGFTFD NTEMAWVRQA
PGKGLEWVSG ITEDGNRTYY ADSVKGRFTI SRDNSKNTLY
LQMNSLRAED TAVYHCAKIR NLHWDVGRQ- FDYWGQGTLV TVSS

BMS2h-745-19 (SEQ ID NO: 416)
EVQLLESGGG LVQPEGSLRL SCAASGFTFD NTEMAWVRQA
PGKGLEWVSG IIEDGNRTYY ADSVKGRFTI SRDNSKNTLY
LQMNSLRAED TAVYYCAKIR NLHWDVGRQ- FDYWGQGTLV TVSS

BMS2h-745-2 (SEQ ID NO: 417)
EVQLLESGGG LVQPGGSLRL SCAASGFTFD NTEMAWVRQA
PGKGLEWVSG ISEDGNRTYY ADSVKGRFTI SRDNSKNTLY
LQMNSLRAED SAVYYCAKIR NLHWDVGRQ- FVYWGQGTLV TVSS

BMS2h-745-3 (SEQ ID NO: 418)
EVQLLESGGG LVEPGGSLRL SCAASGFTFD NTEMAWVRQA
PGKGLEWVSG ITEDGNRTYY ADSVKGRFTI SRDNSKNTLY
LQMSSLRAED TAVYYCAKIR NLHWDVGRQ- FDYWGQGTLV TVSS

BMS2h-745-4 (SEQ ID NO: 419)
EVQLLESGGG LVQPGGSLRL SCAASGFTFD NTEMAWVRQA
PGKGLEWVSG ISEDGNRTYY ADSVKGRFTI SRDNSKNTLY
LQMNSLRAED TAVYHCAKIR NLHWDVGRQ- FDYWGQGTLV TVSS

BMS2h-745-5 (SEQ ID NO: 420)
EVQLLESGGG LVQPGGSLRL SCAASGFTFD NTEMAWVRQA
PGKGLEWVSG ITEDGNRTYY ADSVKGRFII SRDNSKNTLN
LQMNSLRAED TAVYYCAKIR NLHWDVGRQ- FDYWGQGTLV TVSS

BMS2h-745-6 (SEQ ID NO: 421)
EVQLLESGGG LVQPGGSLRL SCAASGFTFD NTEMAWIRQA
PGRGLEWVSG VTEDGNRTYY ADSVKGRFTI SRDNSKNTLY
LQMNSLRAED TAVYYCAKIR NLHWDVGRQ- FDYWGQGTLV TVSS

BMS2h-745-7 (SEQ ID NO: 422)
EVQLLESGGG LVQPGGSLRL SCEASGFTFD NTEMAWIRQA
PGKGLEWVSG IIEDGNRTYY ADSVKGRFTI SRDNTKNTLY
LQMNSLRAED TAVYYCAKIR NLHWDVGRQ- FDYWGQGTLV TVSS

BMS2h-745-8 (SEQ ID NO: 423)
EVQLLESGGG LVQPGGSLRL SCAASGFTFD NTEMAWIRQA
PGKGLEWVSG ITEDGDRTYY ADSVKGRFTI SRDNSKSSLY
LQMNSLRAED TAVYYCAKIR NLHWDVGRQ- FDYWGQGTLV TVSS

BMS2h-745-9 (SEQ ID NO: 424)
EVQLLESGGG SVQPGGSLRL SCAASGFTFD NTEMAWVRQA
PGKGLEWVSG ITEDGNRTYY ADSVKGRFTI SRDNSKNTLY
LQMNSLRAED TAVYYCAKIR NLHWDVGRQ- FVYWGQGTLV TVSS

BMS2h-746 (SEQ ID NO: 425)
EVQLLESGGG LVQPGGSLRL SCAASGFTFG SAEMGWVRQA
PGKGLEWVSG ISRPGQVTYY ADSVKGRFTI SRDNSKNTLY
LQMNSLRAED TAVYYCAKIR NLHWDVGRQ- FDYWGQGTLV TVSS

BMS2h-747 (SEQ ID NO: 426)
EVQLLESGGG LVQPGGSLRL SCAASGFTFD DGTMGWARQA
PGKGLEWVSL ILPSGSRTYY ADSVKGRFTI SRDNSKNTLY
LQMNSLRAED TAVYYCAKHS LTNRP----- FDYWGQGTLV TVSS

BMS2h-748 (SEQ ID NO: 427)
EVQLLESGGG LVQPGGSLRL SCAASGFTFS KYDMRWARQA
PGKGLEWVSD IDAVGTRTYY ADSVKGRFTI SRDNSKNTLY
LQMNSLRAED TAVYYCAIPG GT-------- FDYWGQGTLV TVSS

BMS2h-749 (SEQ ID NO: 428)
EVQLLESGGG LVQPGGSLRL SCAASGFTFE MYGMMWARQA
PGKGLEWVSS IEGAGHATYY ADSVKGRFTI SRDNSKNTLY
LQMNSLRAED TAVYCAIVL GM-------- FDYWGQGTLV TVSS

BMS2h-75 (SEQ ID NO: 429)
EVQLLESGGG LVQPGGSLRL SCAASGFTFL QYPMGWVRQA
PGKGLEWVST ISPVGLTTYY ADSVKGRFTI SRDNSKNTLY
LQMNSLRAED TAVYYCAKLF EGSRIQRDVG FDYWGQGTLV TVSS

BMS2h-750 (SEQ ID NO: 430)
EVQLLESGGG LVQPGGSLRL SCAASGFTFE KYQMGWARQA
PGKGLEWVSS IRGSGLVTYY ADSVKGRFTI SRDNSKNTLY
LQMNSLRAED TAVYYCAKVH TTLHTEVIG- FDYWGQGTLV TVSS

BMS2h-751 (SEQ ID NO: 431)
EVQLLESGGG LVQPGGSLRL SCAASGFTFS QYTMYWARQA
PGKGLEWVSE ISHSGSNTYY ADSVKGRFTI SRDNSKNTLY
LQMNSLRAED TAVYYCAISG LH-------- FDYWGQGTLV TVSS

BMS2h-752 (SEQ ID NO: 432)
EVQLLESGGG LVQPGGSLRL SCAASGFTFS DYAMAWVRQA
PGKGLEWVSR IGVEGGDTYY ADSVKGRFTI SRDNSKNTLY
LQMNSLRAED TAVYYCAKLL RLYRLG---- FDYWGQGTLV TVSS

BMS2h-753 (SEQ ID NO: 433)
EVQLLESGGG LVQPGGSLRL SCAASGFTFA KYDMTWVRQA
PGKGLEWVSK INSDGGLTYY ADSVKGRFTI SRDNSKNTLY
LQMNSLRAED TAVYYCAKGL HGRGFVI--- FDYWGQGTLV TVSS

BMS2h-754 (SEQ ID NO: 434)
EVQLLESGGG LVQPGGSLRL SCAASGFTFS RYDMVWVRQA
PGKGLEWVSR INSMGLATYY ADSVKGRFTI SRDNSKNTLY
LQMNSLRAED TAVYYCAKDY SVAPHGYPLG FDYWGQGTLV TVSS

BMS2h-755 (SEQ ID NO: 435)
EVQLLESGGG LVQPGGSLRL SCAASGFTFK DYSMMWVRQA
PGKGLEWVST ITDNGTSTYY ADSVKGRFTI SRDNSKNTLY
LQMNSLRAED TAVYYCAKHM SLATYLQF-FDYWGQGTLV TVSS

BMS2h-756 (SEQ ID NO: 436)
EVQLLESGGG LVQPGGSLRL SCAASGFTFM EYDMLWVRQA
PGKALEWVSR ISSDGLWTYY ADSVKGRFTI SRDNSKNTLY
LQMNSLRAED TAVYYCAKGV SALAPFDIG- FDYWGQGTLV TVSS

BMS2h-757 (SEQ ID NO: 437)
EVQLLESGGG LVQPGGSLRL SCAASGFTFK EYNMAWVRQA

TABLE 1-continued

Anti-human CD40L VH Domain Amino Acid Sequences

PGKGLEWVSS INFAGRTTYY ADSVKGRFTI SRDNSKNTLY
LQMNSLRAED TAVYYCAKLS LPLDIFS--- FDYWGQGTLV TVSS

BMS2h-758 (SEQ ID NO: 438)
EVQLLESGGG LVQPGGSLRL SCAASGFTFG DYGMNWVRQA
PGKGLEWVSH ISSNGRFTYY ADSVKGRFTI SRDNSKNTLY
LQMNSLRAED TAVYYCAETS GY-------- FDYWGQGTLV TVSS

BMS2h-758-1 (SEQ ID NO: 439)
EVQLLESGGG LVQPGGSLRL SCAASGFTFG DYGMNWVRQA
PGKGLEWVSH ISSNGRFTYY ADSVKGRFTI SRDNSKNMLY
LRMNSLRAED TAVYYCAETS GY-------- YEYWGQGTLV TVSS

BMS2h-758-2 (SEQ ID NO: 440)
EVQLLESGGG LVQPGGSLRL SCAASGFTFG DYGMNWVRQA
PGKGLEWVSH ISSNGRFTYY ADSVKGRFTI SRDNSKNTLY
LQMNSLRAED TAVYYCAETS GY-------- FEYWGQGTLV TVSS

BMS2h-758-3 (SEQ ID NO: 441)
EVQLLESGGG LVQPGGSLRL SCAASGFTFG DYGMNWVRQA
PGKGLEWVSH ISSNGRFTYY ADSVKGRFTI SRDNSKNTLY
LQMNSLRAED TAVYYCAETS SY-------- FEYWGQGTLV TVSS

BMS2h-758-4 (SEQ ID NO: 442)
EVQLLESGGG LVQPGGSLRL SCAASGFTFG DYGMNWVRQA
PGKGLEWVSH ISSNGRFTYY ADSVKGRFTI SRDNSKNTLF
LQMNSLRAED TAVYYCAETS GY-------- YEYWGHGTLV TVSS

BMS2h-758-5 (SEQ ID NO: 443)
EVQLLESGGG LVQPGGSLRL SCAASGFAFG DYGMNWVRQA
PGKGLEWVSH ISSNGRFTYY ADSVKGRFTI SRDNSKNTLY
LQMNSLRAED TAVYYCAETS GY-------- FEYWGQGTLV TVSS

BMS2h-758-6 (SEQ ID NO: 444)
EVQLLESGGG LVQPGGSLRL SCAASGFTFG DYGMNWVRQA
PGKGLEWVSH ISSNGRFIYY ADSVKGRFTI SRDNSKNTLY
LQMNSLRAED TAVYYCAETS GY-------- FEYWGQGTLV TVSS

BMS2h-759 (SEQ ID NO: 445)
EVQLLESGGG LVQPGGSLRL SCAASGFTFR EYVMGWVRQA
PGKGLEWVST INGLGNVTYY ADSVKGRFTI SRDNTKNTLY
LQMNSLRAEE TAVYYCAIQL PN-------- FDYWGQGTLV TVSS

BMS2h-760 (SEQ ID NO: 446)
EVQLLESGGG LVQPGGSLRL SCAASGFTFG NDGMWWVRQA
PGKGLEWVSF INVDGRETYY ADSVKGRFTI SRDNSKNTLY
LQMNSLRAED TAVYYCAEWS PGRVQ----- FDYWGQGTLV TVSS

BMS2h-761 (SEQ ID NO: 447)
EVQLLESGGG LVQPGGSLRL SCAASGFTFG GWDMAWVRQA
PGKGLEWVSS IAHEGGETYY ADSVKGRFTI SRDNSKNTLY
LQMNSLRAED TAVYYCAKYV PGSPL----- FDYWGQRTLV TVSS

BMS2h-762 (SEQ ID NO: 448)
EVQLLESGGG LVQPGGSLRL SCAASGFTFD QGWMYWVRQA
PGKGLEWVSG IGSNGPRTSY ADSVKGRFTI SRDNSKNTLY
LQMNSLRAED TAVYYCAKSG EY-------- FDYWGQGTLV TVSS

BMS2h-763 (SEQ ID NO: 449)
EVQLLESGGG LVQPGGSLRL SCAASGFTFR QSDMWWVRQA
PGKGLEWVSV IGNNGEFTYY ADSVKGRFTI SRDNSKNTLY
LQMNSLRAED TAVYYCAKDN WLL------- FDYWGQGTLV TVSS

BMS2h-764 (SEQ ID NO: 450)
EVQLLESGGG LVQPGGSLRL SCAASGFTFD LSTMYWVRQA
PGKGLEWVST IGGDGSHTYY ADSVKGRFTI SRDNSKNTLY
LQMNSLRAED TAVYYCAEGT QY-------- FDYWGQGTLV TVSS

BMS2h-765 (SEQ ID NO: 451)
EVQLLESGGG LVQPGGSLRL SCAASGFTFS AYTMEWVRQA
PGKGLEWVSS IGVTGYDTYY ADSVKGRFTI SRDNSKNTLY
LQMNSLRAED TAVYYCAKGG QG-------- FDYWGQGTLV TVSS

BMS2h-766 (SEQ ID NO: 452)
EVQLLESGGG LVQPGGSLRL SCAASGFTFG DYGMSWVRQA
PGKGLEWVSY IDPLGRLTYY ADSVKGRFTI SRDNSKNTLY
LQMNSLRAED TAVYYCAEDL SSLQYGVSPN FDYWGQGTLV TVSS

BMS2h-767 (SEQ ID NO: 453)
EVQLLESGGG LVQPGGSLRL SCAASGFTFF HYSMSWVRQA
PGKGLEWVSS IGPVGRETYY ADSVKGRFTI SRDNSKNTLY
LQMNSLRAED TAVYYCAKMI QSPLFKD--- FDYWGQGTLV TVSS

BMS2h-768 (SEQ ID NO: 454)
EVQLLESGGG LVQPGGSLRL SCAASGFTFE WYDMYWVRQA
PGKGLEWVSR IDSGGNQTYY ADSVKGRFTI SRDNSKNTLY
LQMNSLRAED TAVYYCAEAS LWKWRL---- FDYWGQGTLV TVSS

BMS2h-77 (SEQ ID NO: 455)
EVQLLESGGG LVQPGGSLRL SCAASGFTFE EYGMAWVRQA
PGKGLEWVST ISPLGISTYY ADSVKGRFTI SRDNSKNTLY
LQMNSLRAED TAVYYCAKHA TSQESLRS-FDYWGQGTLV TVSS

BMS2h-770 (SEQ ID NO: 456)
EVQLLESGGG LVQPGGSLRL SCAASGFTFS KYEMMWVRQA
PGKGLEWVSA ISGSGGSTYY ADSVKGRFTI SRDNSKNTLY
LQMNSLRAED TAVYYCAKGP LPDAFWTRG- FDYWGQGTLV TVSS

BMS2h-771 (SEQ ID NO: 457)
EVQLLESGGG LVQPGGSLRL SCAASGFTFG TYSMAWVRQA
PGKGLEWVST IDRHGLATYY ADSVKGRFTI SRDNSKNTLY
LQMNSLRAED TAVYYCAKTP GSSWQTV--- FGYWGQGTLV TVSS

BMS2h-772 (SEQ ID NO: 458)
EVQLLESGGG LVQPGGSLRL SCAASGFTFE SYPMGWVRQA
PGKGLEWVSS IDHHGHSTYY ADSAKGRFTI SRDNSKNTLY
LQMNSLRAED TAVYYCAKLL RVSMIFG--- FDYWGQGTLV TVSS

BMS2h-773 (SEQ ID NO: 459)
EVQLLESGGG LVQPGGSLRL SCAASGFTFV QYGMSWVRQA
PGKGLEWVSW ISSSGTYTYY ADSVKGRFTI SRDNSKNTLY
LQMNSLRAED TAVYYCAETS RM-------- FDYWGQGTLV TVSS

BMS2h-774 (SEQ ID NO: 460)
EVQLLESGGG LVQPGGSLRL SCAASGFTFR EYDMGWVRQA
PGKGLEWVSL ISPPGRTTYY ADSVKGRFTI SRDNSKNTLY
LQMNSLRAED TAVYYCAKVV ILGYTNR--- FDYWGQGTLV TVSS

BMS2h-775 (SEQ ID NO: 461)
EVQLLESGGG LVQPGGSLRL SCAASGFTFP NYGMLWVRQA
PGKGLEWVSS INSSGMETYY ADSVKGRFTI SRDNSKNTLY
LQMNSLRAED TAVYYCAKFF RLNDHNSVFG FDYWGQGTLV TVSS

BMS2h-776 (SEQ ID NO: 462)
EVQLLESGGG LVQPGGSLRL SCAASGFTFK DYKMMWIRQA
PGKGLEWVSS IVGSGSMTYY ADSVKGRFTI SRDNSKNTLY
LQMNSLRAED TAVYYCAKGP GY-------- FDYWGQGTLV TVSS

BMS2h-777 (SEQ ID NO: 463)
EVQLLESGGG LVQPGGSLRL SCAASGFTFH NYAMGWVRRA
PGKGLEWVSS IDEHGTITYY ADSVKGRFTI SRDNSKNTLY
LQMNSLRAED TAVYYCAKDS LDRVWI---- FDYWGQGTLV TVSS

BMS2h-778 (SEQ ID NO: 464)
EVQLLESGGG LVQPGGSLRL SCAASGFTFA DYPMTWVRQA
PGKGLEWVSS IYSAGSPTYY ADSVKGRFTI SRDNSKNTLY
LQMNSLRAED TAVYYCAKLY HREPILFG-FDYWGQGTLV TVSS

BMS2h-78 (SEQ ID NO: 465)
EVQLLESGGG LVQPGGSLRL SCAASGFTFE RYQMAWVRQA
PGKGLEWVST ISSDGGTYY ADSVKGRFTI SRDNSKNTLY
LQMNSLRAED TAVYYCAKPG HR-------- FDYWGQGTLV TVSS

BMS2h-780 (SEQ ID NO: 466)
EVQLLESGGG LVQPGGSLRL SCAASGFTFG SYTMMWVRQA
PGKGLEWVSE IDRTGERTYY ADSVKGRFTI SRDNSKNTLY
LQMNSLRAED TAVYYCAEPG FASLP----- FDYWGQGTLV TVSS

BMS2h-781 (SEQ ID NO: 467)
EVQLLESGGG LVQPGGSLRL SCAASGFTFT DYTMYWVRQA
PGKGLEWVSK ISPSGRSTYY ADSVKGRFTI SRDNSKNTLY
LQMNSLRAED TAVYYCAKDP FG-------- FDYWGQGTLV TVSS

TABLE 1-continued

Anti-human CD40L VH Domain Amino Acid Sequences

BMS2h-782 (SEQ ID NO: 468)
EVQLLESGGG LVQPGGSLRL SCAASGFTFD DAEMFWVRQA
PGKGLEWVSS IDARGLTTYY ADPVKGRFTI SRDNSKNTLY
LQMNSLRAED TAVYYCAEAT SAMYP----- FDYWGQGTLV TVSS

BMS2h-783 (SEQ ID NO: 469)
EVQLLESGGG LVQPGGSLRL SCAASGFTFR DYDMGWVRQA
PGKGLEWVST ISPLGHFTYY ADSVKGRFTI SRDNSKNTLY
LQMNSLRAED TAVYYCAKSG FHEYTEG--- FDYWGQGTLV TVSS

BMS2h-784 (SEQ ID NO: 470)
EVQLLESGGG LVQPGGSLRL SCAASGFTFD RAGMGWVRQA
PGKGLEWVSL IGRGGDITYY ADSVKGRFTI SRDNSKNTLY
LQMNSLRAED TAVYYCAKIR NLHWDVGRQ- FDYWGQGTLV TVSS

BMS2h-80 (SEQ ID NO: 471)
EVQLLESGGG LVQPGGSLRL SCAASGFTFG RYQMAWVRQA
PGKGLEWVSS ISSDGGGTYY ADSVKGRFTI SRDNSKNTLY
LQMNSLRAED TAVYYCAKPS RR-------- FDYWGQGTLV TVSS

BMS2h-81 (SEQ ID NO: 472)
EVQLLESGGG LVQPGGFLRL SCAASGFTFE LYPMAWVRQA
PGKGLEWVSS ISPVGFLTYY ADSVKGRFTI SRDNSKNTLY
LQMNSLRAED TAVYYCAKGH EGSYTPRSA- FDYWGQGTLV TVSS

BMS2h-82 (SEQ ID NO: 473)
EVQLLESGGG LVQPGGSLRL SCAASGFTFV AYPMAWVRQA
PGKGLEWVST IAPLGGNTYY ADSVKGRFTI SRDNSKNTLY
LQMNSLRAED TAVYYCAKRP EGLQIDSQN- FDYWGQGTLV TVSS

BMS2h-83 (SEQ ID NO: 474)
EVQLLESGGG LVQPGGSLRL SCAASGFTFA LYQMAWVRQA
PGKGLEWVSS IDSSGSDTYY ADSVKGRFTI SRDNSKNTLY
LQMNSLRAED TAVYYCAKPE RD-------- FDYWGQGTLV TVSS

BMS2h-84 (SEQ ID NO: 475)
EVQLLESGGG LVQPGGSLRL SCAASGFTFR QYQMAWARQA
PGKGLEWVST IASDGVSTYY ADSVKGRFTI SRDNSKNTLY
LQMNSLRAED TAVYYCAKVG RD-------- FDYWGQGTLV TVSS

BMS2h-85 (SEQ ID NO: 476)
EVQLLESGGG LVQPGGSLRL SCAASGFTFE QYDMRWVRQA
PGKGLEWVSW IDEAGHETYY ADSVKGRFTI SRDNSRNTLY
LQMNSLRAED TAVYYCAKGM DG-------- FDYWGQGTLV TVSS

BMS2h-92 (SEQ ID NO: 477)
EVQLLESGGG LVQPGGSLRL SCAASGFTFV DYPMGWVRQA
PGKGLEWVST ISTGGFSTYY ADSVKGRFTI SRDNSKNTLY
LQMNSLRAED TAVYYCAKAR YYYLSQIKN- FDYWGQGTLV TVSS

BMS2h-93 (SEQ ID NO: 478)
EVQLLESGGG LVQPGGSLRL SCAASGFTFD IYGMTWVRQA
PGKGLEWVSS ISPLGLVTYY ADPVKGRFTI SRDNSKNTLY
LQMNSLRAED TAVYYCAKLK EHGDVP---- FDYWGQGTLV TVSS

BMS2h-94 (SEQ ID NO: 479)
EVQLLESGGG LVQPGGSLRL SCAASGFTFE LYPMSWVRQA
PGKGLEWVST ISPTGLLTYY ADSVKGRFTI SRDNSKNTLY
LQMNSLRAED TAVYYCAKFK RSGKTDDTN- FDYWGQGTLV TVSS

BMS2h-95 (SEQ ID NO: 480)
EVQLLESGGG LVQPGGSLRL SCAASGFTFR EYDMLWVRQA
PGKGLEWVST IVGDGNGTYY ADSVKGRFTI SRDNSKNTLY
LQMNSLRAED TAVYYCAKQD RQ-------- FDYWGQGTLV TVSS

BMS2h-97 (SEQ ID NO: 481)
EVQLLESGGG LVQPGGSLRL SCAASGFTFE EYGMSWVRQA
PGKGLEWVST ISPIGVTTYY ADSVKGRFTI SRDNSKNTLY
LQMNSLRAED TAVYYCAKNA YDRKSN---- FDYWGQGTLV TVSS

BMS2h-98 (SEQ ID NO: 482)
EVQLLESGGG LVQPGGSLRL SCAAGGSLRL SCAASGFTFD RYVMVWVRQA
PGKDLEWVSG ITPSGRRTYY ADSVKGRFTI SRDNSKDTLY
LQMNSLRAED TAVYYCAKVL GRHFDPLLPS FDYWGQGTLV TVSS

BMS2h-99 (SEQ ID NO: 483)
EVQLLESGGG LVQPGGSLRL SCAASGFTFE DYAMSWVRQA
PGKGLEWVST ITPGGFWTYY ADSVKGRFTI SRDNSKNTLY
LQMNSLRAED TAVYYCAKTS SGELQLVED- FDYWGQGTLV TVSS

TABLE 2

Human Anti-CD40L VH Domain Encoding Nucleotide Sequences

BMS2h-10 (SEQ ID NO: 484)
GAGGTGCAGCTGTTGGAGTCTGGGGGAGGCTTAGTACAGCCTGGGGGGTC
CCTGCGTCTCTCCTGTGCAGCCTCCGGATTCACCTTTATTGCTTATGATA
TGAGTTGGGTCCGCCAGGCTCCAGGGAAGGGTCTGGAGTGGGTCTCATGG
ATTGATGAGTGGGGTCTGCAGACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAAAAGACG
CCTGAGGAGTTTGACTACTGGGGTCAGGGAACCCTGGTCACCGTCTCGA
GC

BMS2h-11 (SEQ ID NO: 485)
GAGGTGCAGCTGTTGGAGTCTGGGGGAGGCTTGGTACAGCCTGGGGGGTC
CCTGCGTCTCTCCTGTGCAGCCTCCGGATTCACCTTTGGTGATTATGAGA
TGAGTTGGGTCCGCCAGGCTCCAGGGAAGGGTCTAGAGTGGGTCTCAGGG
ATTGATGGTGAGGGTTCTGATACATACTACGCAGACTCCGTGAAGGGCCG
GTTCACCATCTCCCGCGACAATTCCAAGAACACGCTGTATCTGCAAATGA
ACAGCCTGCGTGCCGAGGATACCGCGGTATATTACTGTGCGAAACCGGGG
AGGAGTTTTGACTACTGGGGTCAGGGAACCCTGGTCACCGTCTCGAGC

BMS2h-111 (SEQ ID NO: 486)
GAGGTGCAGCTGTTGGAGTCTGGGGGAGGCTTGGTACAGCCTGGGGGGTC
CCTGCGTCTCTCCTGTGCAGCCTCCGGATTCACCTTTGAGCTTATCCTA
TGACGTGGGTCCGCCAGGCTCCAGGGAAGGGTCTAGAGTGGGTCTCAACG
ATTCATGGTTCTGGTAGTGCTACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAAGGGCCG
TATACTAGTCGGCATAATAGTCTTGGGCATTTTGACTACTGGGGTCAGGG
AACCCTGGTCACCGTCTCGAGC

BMS2h-112 (SEQ ID NO: 487)
GAGGTGCAGCTGTTGGAGTCTGGGGGAGGCTTGGTACAGCCTGGGGGGTC
CCTGCGTCTCTCCTGTGCAGCCTCCGGATTCACCTTTATGGATTATCCTA
TGGGGTGGGTCCGCCAGGCTCCAGGGAAGGGTCTAGAGTGGGTCTCATCT
ATTGGGTGTTGGTATGAGTACATACTACGCAGACTCCGTGAAGGGCCG
GTTCACCATCTCCCGCGACAATTCCAAGAACACGCTGTATCTGCAAATGA
ACAGCCTGCGTGCCGAGGATACCGCGGTATATTACTGTGCGAAATATGGG
GGGACTAGTGGTAGGCATAATACTAAGTTTGACTACTGGGGTCAGGGAAC
CCTGGTCACCGTCTCGAGC

BMS2h-113 (SEQ ID NO: 488)
GAGGTGCAGCTGTTGGAGTCTGGGGGAGGCTTGGTACAGCCTGGGGGGTC
CCTGCGTCTCTCCTGTGCAGCCTCCGGATTCACCTTTACTGAGTATCCTA
TGAGTTGGGTCCGCCAGGCTCCAGGGAAGGGTCTAGAGTGGGTCTCAGTT
ATTTCTCCTCTTGGTTTTACGACATACTACGCAGACTCCGTGAAGGGCCG
GTTCACCATCTCCCGCGACAATTCCAAGAACACGCTGTATCTGCAAATGA
ACAGCCTGCGTGCCGAGGATACCGCGGTATATTACTGTGCGAAATGGACT
GGTGGGAGTGGTATTTTGAATTCTTCTTTTGACTACTGGGGTCAGGGAAC
CCTGGTCACCGTCTCGAGC

BMS2h-114 (SEQ ID NO: 489)
GAGGTGCAGCTGTTGGAGTCTGGGGGAGGCTTGGTACAGCCTGGGGGGTC
CCTGCGTCTCTCCTGTGCAGCCTCCGGATTTAGGGTTAGCAATTACGATT
TGACCTGGGTCCGCCAGGCTCCAGGGAAGGGTCTAGAGTGGGTATCAACC
ATTAGTGCCACAAACGGTAGCACATACTACGCAGACTCCGTGAAGGGCCG
GTTCACCATCTCCCGTGACAATTCCAAGAACACGCTGTATCTGCAAATGA
ACAGCCTGCGTGCCGAGGACACCGCGGTATATTATTGCGCGGCAGTGACG
TGGTGGTTGTTGCGTCATAACGACAACTTGGGGTTTTGGGGTCAGGGAAC
CCTGGTCACCGTCTCGAGC

BMS2h-115 (SEQ ID NO: 490)
GAGGTGCAGCTGTTGGAGTCTGGGGGAGGCTTGGTACAGCCTGGGGGGTC
CCTGCGTCTCTCCTGTGCAGCCTCCGGATTTAGCATTAGCTATAAGAATA
TGGCCTGGGTCCGCCAGGCTCCAGGGGTCTAGAGTGGGTATCAGCC
ATTAAGCGGCAAACGGTAGCACATACTACGCAGACTCCGTGAAGGGCCG
GTTCACCATCTCCCGTGACAATTCCAAGAACACGCTGTATCTGCAAATGA
ACAGCCTGCGTGCCGAGGACACCGCGGTATATTATTGCGCGACAGGGAGT
CAGAAGAAGCGGACCTACACGTTCGACTTTTGGGGTCAGGGAACCCTGGT
CACCGTCTCGAGC

TABLE 2-continued

Human Anti-CD40L VH Domain Encoding Nucleotide Sequences

BMS2h-12 (SEQ ID NO: 491)
GAGGTGCAGCTGTTGGAGTCTGGGGGAGGCTTGGTACAGCCTGGGGGGTC
CCTGCGTCTCTCCTGTGCAGCCTCCGGATTCACCTTTAGGTTGTATGAGA
TGGCGTGGGTCCGCCAGGCTCCAGGGAAGGGTCTAGAGTGGGTCTCAGGG
ATTGATATTTTGGGTTCGAGGACATACTACGCAGACTCCGTGAAGGGCCG
GTTCACCATCTCCCGCGACAATTCCAAGAACACGCTGTATCTGCAAATGA
ACAGCCTGCGTGCCGAGGATACCGCGGTATATTACTGTGCGAAAGATCTG
TCGTGGCAGGGTTTTGACTACTGGGGTCAGGGAACCCTGGTCACCGTCTC
GAGC

BMS2h-120 (SEQ ID NO: 492)
GAGGTGCAGCTGTTGGAGTCTGGGGGAGGCTTGGTACAGCCTGGGGGGTC
CCTGCGTCTCTCCTGTGCAGCCTCCGGATTCACCTTTAGGTCTTATACGA
TGGGTTGGGTCCGCCAGGCTCCAGGGAAGGGTCTAGAGTGGGTCTCATCT
ATTAATCCTATGGGTTATCAGACATACTACGCAGACTCCGTGAAGGGCCG
GTTCACCATCTCCCGCGACAATTCCAAGAACACGCTGTATCTGCAAATGA
ACAGCCTGCGTGCCGAGGATACCGCGGTATATTACTGTGCGAAACATGGG
GTGGGGAAGGGTACTAAGCCGCATAATTTTGACTACTGGGGTCAGGGAAC
CCTGGTCACCGTCTCGAGC

BMS2h-121 (SEQ ID NO: 493)
GAGGTGCAGCTGTTGGAGTCTGGGGGAGGCTTGGTACAGCCTGGGGGGTC
CCTGCGTCTCTCCTGTGCAGCCTCCGGATTCACCTTTGAGCTGTATAGGA
TGTCTTGGGTCCGCCAGGCTCCAGGGAAGGGTCTAGAGTGGGTCTCAGAG
ATTAGTGGTAGTGGTTTTCCTACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAAAGTCTG
CATGATAAGACTCAGCATCATCAGGAGTTTGACTACTGGGGTCAGGGAAC
CCTGGTCACCGTCTCGAGC

BMS2h-123 (SEQ ID NO: 494)
GAGGTGCAGCTGTTGGAGTCTGGGGGAGGCTTGGTACAGCCTGGGGGGTC
CCTGCGTCTCTCCTGTGCAGCCTCCGGATTCACCTTTATTGAGTATCCTA
TGCGGTGGGTCCGCCAGGCTCCAGGGAAGGGTCTAGAGTGGGTCTCACTT
ATTTCTCCGTCTGGTGTGTTTACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAAGGGGAT
GAGTCTAGTACTTTTGACTACTGGGGTCAGGGAACCCTGGTCACCGTCTC
GAGC

BMS2h-124 (SEQ ID NO: 495)
GAGGTGCAGCTGTTGGAGTCTGGGGGAGGCTTGGTACAGCCTGGGGGGTC
CCTGCGTCTCTCCTGTGCAGCCTCCGGATTCACCTTTAAGCGGTATGATA
TGGATTGGGTCCGCCAGGCTCCAGGGAAGGGTCTAGAGTGGGTCTCAACG
ATTGGGAGTTCGGGTTATCCGACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGGAAAGGATG
CCTGGTTATTTTCCTGGGTTTGCTCGGCAGTTTGACTACTGGGGTCAGGG
AACCCTGGTCACCGTCTCGAGC

BMS2h-125 (SEQ ID NO: 496)
GAGGTGCAGCTGTTGGAGTCTGGGGGAGGCTTGGTACAGCCTGGGGGGTC
CCTGCGTCTCTCCTGTGCAGCCTCCGGATTCACCTTTTGGCGGTATGCTA
TGGGGTGGGTCCGCCAGGCTCCAGGGAAGGGTCTAGAGTGGGTCTCAACG
ATTAATGATGAGGGTCGGGAGACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAAAAGCGG
GTGTCTAGTTCTGTGAATGCTCCGTATGAGTTTGACTACTGGGGTCAGGG
AACCCTGGTCACCGTCTCGAGC

BMS2h-126 (SEQ ID NO: 497)
GAGGTGCAGCTGTTGGAGTCTGGGGGAGGCTTGGTACAGCCTGGGGGGTC
CCTGCGTCTCTCCTGTGCAGCCTCCGGATTCACCTTTGCGAATTATAGTA
TGAGTTGGGTCCGCCAGGCCCAGGGAAGGGTCTAGAGTGGGTCTCATCG
ATTGATCGTCTTGGTACGCATACATACTACGCAGACTCCGTGAAGGGCCG
GTTCACCATCTCCCGCGACAATTCCAAGAACACGCTGTATCTGCAAATGA
ACAGCCTGCGTGCCGAGGATACCGCGGTATATTACTGTGCGAAAGTCTGG
GCTGATCTTATTGCTGGGCATGCGGAGTTTGACTACTGGGGTCAGGGAAC
CCTGGTCACCGTCTCGAGC

BMS2h-127 (SEQ ID NO: 498)
GAGGTGCAGCTGTTGGAGTCTGGGGGAGGCTTGGTACAGCCTGGGGGGTC
CCTGCGTCTCTCCTGTGCAGCCTCCGGATTCACCTTTCCGTCGTATGATA
TGGCGTGGGTCCGCCAGGCTCCAGGGAAGGGTCTAGAGTGGGTCTCAGGG
ATTTCGAGGTCTGGTTCTATGACATACTACGCAGACTCCGTGAAGGGCCG
GTTCACCATCTCCCGCGACAATTCCAAGAACACGCTGTATTTGCAAATGA
ACAGCCTGCGTGCCGAGGACACCGCGGTATATTACTGTGCGAAAGGTGTT
GATGCGCATGTTTATTATATGGAGCCTTTTTTTGACTACTGGGGTCAGGG
AACCCTGGTCACCGTCTCGAGC

BMS2h-128 (SEQ ID NO: 499)
GAGGTGCAGCTGTTGGAGTCTGGGGGAGGCTTGGTACAGCCTGGGGGGTC
CCTGCGTCTCTCCTGTGCAGCCTCCGGATTCACCTTTGAGAGGTATCAGA
TGGCGTGGGTCCGCCAGGCTCCAGGGAAGGGTCTAGAGTGGGTCTCAACG
ATTAGTTCTGATGGTGGGGGGACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAACCGGGT
ACTGTTTTTGACTACTGGGGTCAGGGAACCCTGGTCACCGTCTCGAGC

BMS2h-129 (SEQ ID NO: 500)
GAGGTGCAGCTGTTGGAGTCTGGGGGAGGCTTGGTACAGCCTGGGGGGTC
CCTGCGTCTCTCCTGTGCAGCCTCCGGATTCACATTTCCGAAGTATGAGA
TGGCGTGGGTCCGCCAGGCTCCAGGGAAGGGTCTAGAGTGGGTCTCATCT
ATTGATGGTGATGGTAAGTCTACATACTACGCAGACTCCGTGAAGGGCCG
GTTCACCATCTCCCGCGACAATTCCAAGAACACGCTGTATCTGCAAATGA
ACAGCCTGCGTGCCGAGGATACCGCGGTATATTACTGTGCGAAACCGGAT
CAGTTTTTTGACTACTGGGGTCAGGGAACCCTGGTCACCGTCTCGAGC

BMS2h-13 (SEQ ID NO: 501)
GAGGTGCAGCTGTTGGAGTCTGGGGGAGGCTTGGTACAGCCTGGGGGGTC
CCTGCGTCTCTCCTGTGCAGCCTCCGGATTCACCTTTTCTTATTATTCGA
TGTATTGGGTCCGCCAGGCTCCAGGGAAGGGTCTAGAGTGGGTCTCATCG
ATTTCGCCTTTTGGTTGGGGTACATACTACGCAGACTCCGTGAAGGGCCG
GTTCACCATCTCCCGCGACAATTCCAAGGACACGCTGTATCTGCAAATGA
ACAGCCTGCGTGCCGAGGACACCGCGGTATATTACTGTGCGAAATATGGG
GAGACGAGTGGTCCGATTTCTGAGAATTTTGACTACTGGGGTCAGGGAAC
CCTGGTCACCGTCTCGAGC

BMS2h-130 (SEQ ID NO: 502)
GAGGTGCAGCTGTTGGAGTCTGGGGGAGGCTTGGTACAGCCTGGGGGGTC
CCTGCGTCTCTCCTGTACAGCCTCCGGATTCACCTTTGCGGGTTATCAGA
TGTCGTGGGTCCGCCAGGCTCCAGGGAAGGGTCTAGAGTGGGTCTCAAGT
ATTACTAATGAGGGTGTTTCTACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAACCGGGG
AAGTATTTTGACTACTGGGGTCAGGGAACCCTGGTCACCGTCTCGAGC

BMS2h-131 (SEQ ID NO: 503)
GAGGTGCAGCTGTTGGAGTCTGGGGGAGGCTTGGTACAGCCTGGGGGGTC
CCTGCGTCTCTCCTGTGCAGCCTCCGGATTCACCTTTGGGGAGTATGAGA
TGGTGTGGGTCCGCCAGGCTCCAGGGAAGGGTCTGGAGTGGGTCTCATCT
ATTACGTCGGATGGTCTGAGTACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAACCGGGT
ATTCGTTTTGACTACTGGGGTCAGGGAACCCTGGTCACCGTCTCGAGC

BMS2h-132 (SEQ ID NO: 504)
GAGGTGCAGCTGTTGGAGTCTGGGGGAGGCTTGGTACAGCCTGGGGGGTC
CCTGCGTCTCTCCTGTGCAGCCTCCGGATTCACCTTTGCTGATTATGATA
TGGCTTGGGTCCGCCAGGCTCCAGGGAAGGGTCTAGAGTGGGTCTCAGGT
ATTGTTGATGATGGTCTTATGACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAACCGGAT
GTTGCTTTTGACTACTGGGGTCAGGGGACCCTGGTCACCGTCTCGAAC

BMS2h-133 (SEQ ID NO: 505)
GAGGTGCAGCTGTTGGAGTCTGGGGGAGGCTTGGTACAGCCTGGGGGGTC
CCTGCGTCTCTCCTGTGCAGCCTCCGGATTCACCTTTATTGGTTATGCTA
TGGCGTGGGTCCGCCAGGCTCCAGGGAAGGGTCTAGAGTGGGTCTCAAGT
ATTGGTCCTTTGGGTGCGACTACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAATTGCCT
GCTGGTACGAGTAGTCATAGTGTGGATTTTGACTACTGGGGTCAGGGAAC
CCTGGTCACCGTCTCGAGC

BMS2h-134 (SEQ ID NO: 506)
GAGGTGCAGCTGTTGGAGTCTGGGGGAGGCTTGGTACAGCCTGGGGGGTC
CCTGCGTCTCTCCTGTGCAGCCTCCGGATTCACCTTTGGGATTATGAGA
TGACTTGGGTCCGCCAGGCTCCAGGGAAGGGTCTAGAGTGGGTCTCATCT
ATTAGTGATGGTGTTTCTACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAACCGTCG
GTTCAGTTTGACTACTGGGGTCAGGGAACCCTGGTCACCGTCTCGAGC

TABLE 2-continued

Human Anti-CD40L VH Domain Encoding Nucleotide Sequences

BMS2h-135 (SEQ ID NO: 507)
GAGGTGCAGCTGTTGGAGTCTGGGGGAGGCTTGGTACAGCCTGGGGGGTC
CCTGCGTCTCTCCTGTGCAGCCTCCGGATTCACCTTTCGTAGGTATGTTA
TGGGGTGGGTCCGCCAGGCTCCAGGGAAGGGTCTAGAGTGGGTCTCATGG
ATTGAGGCTGATGGTCGTACGACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAAGGGCTT
ACGGATCAGCATGTTATTGAGTTTGACTACTGGGGTCAGGGAACCCTGGT
CACCGTCTCGAGC

BMS2h-136 (SEQ ID NO: 508)
GAGGTGCAGCTGTTGGAGTCTGGGGGAGGCTTGGTACAGCCTGGGGGGTC
CCTGCGTCTCTCCTGTGCAGCCTCCGGATTCACCTTTGATGTTATCGTA
TGGGGTGGGTCCGCCAGGCTCCAGGGAAGGGTCTAGAGTGGGTCTCATCG
ATTGCTCCGGATGGTAATTATACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAATTTTGG
GGGATGCAGTTTGACTACTGGGGTCAGGGAACCCTGGTCACCGTCTCGA
GC

BMS2h-137 (SEQ ID NO: 509)
GAGGTGCAGCTGTTGGAGTCTGGGGGAGGCTTGGTACAGCCTGGGGGGTC
CCTGCGTCTCTCCTGTGCAGCCTCCGGATTCACCTTTGCTTCGTATCCGA
TGGGTTGGGTCCGCCAGGCTCCAGGGAAGGGTCTAGAGTGGGTCTCAAGT
ATTGGTCCTATTGGTTTTACTACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAATGAAG
TCGCCTTATAAGCCGCAGTTTGACTACTGGGGTCAGGGAACCCTGGTCAC
CGTCTCGAGC

BMS2h-138 (SEQ ID NO: 510)
GAGGTGCAGCTGTTGGAGTCTGGGGGAGGCTTGGTACAGCCTGGGGGGTC
CCTGCGTCTCTCCTGTGCAGCCTCCGGATTCACCTTTTTGGCTTATTGGA
TGGTTTGGGTCCGCCAGGCTCCAGGGAAGGGTCTAGAGTGGGTCTCATCT
ATTTCTCCGTCGGGTACGCATACATACTACGCAGACTCCGTGAAGGGCCG
GTTCACCATCTCCCGCGACAATTCCAAGAACACGCTGTATCTGCAAATGA
ACAGCCTGCGTGTCGAGGACACCGCGGTATATTACTGTGCGAAATATACT
GAGCCGGGGTTGGGTTCTTTTGACTACTGGGGTCAGGGAACCCTGGTCAC
CGTCTCGAGC

BMS2h-139 (SEQ ID NO: 511)
GAGGTGCAGCTGTTGGAGTCTGGGGGAGGCTTGGTACAGCCTGGGGGGTC
CCTGCGTCTCTCCTGTGCAGCCTCCGGATTCACCTTTTCGAATTATGAGA
TGGGGTGGGTCCGCCAGGCTCCAGGGAAGGGTCTAGAGTGGGTCTCAGTG
ATTTCTGAGGTGGGTTCTCTGACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAACCTCAT
GATAGTTCGATTGGGTTTGACTACTGGGGTCAGGGAACCCTGGTCACCGT
CTCGAGC

BMS2h-14 (SEQ ID NO: 512)
GAGGTGCAGCTGTTGGAGTCTGGGGGAGGCTTGGTACAGCCTGGGGGGTC
CCTGCGTCTCTCCTGTGCAGCCTCCGGATTCACCTTTGGTCTTATGATA
TGACGTGGGTCCGCCAGGCTCCAGGGAAGGGTCTAGAGTGGGTCTCATCT
ATTATGGCTTCGGGTGATGATACATACTACGCAGACTCCGTGAAGGGCCG
GTTCACCATCTCCCGCGACAATTCCAAGAACACGCTGTATCTGCAAATGA
ACAGCCTGCGTGCCGAGGATACCGCGGTATATTACTGTGCGAAATGGGAT
CGGGATTTTGACTACTGGGGTCAGGGAACCCTGGTCACCGTCTCGAGC

BMS2h-15 (SEQ ID NO: 513)
GAGGTGCAGCTGTTGGAGTCTGGGGGAGGCTTGGTACAGCCTGGGGGGTC
CCTGCGTCTCTCCTGTGCAGCCTCCGGATTCACCTTTGAGGAGTATGTTA
TGTCGTGGGTCCGCCAGGCTCCAGGGAAGGGTCTGGAGTGGGTCTCAACT
ATTTCTCCTATTGGTCTGACTACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGGAATTTCCT
TTGATTATTCTTCCTGATTTTGACTACTGGGGTCAGGGAACCCTGGTCAC
CGTCTCGAGC

BMS2h-16 (SEQ ID NO: 514)
GAGGTGCAGCTGTTGGAGTCTGGGGGAGGCCTGGTACAGCCTGGGGGGTC
CCTGCGTCTCTCCTGTGCAGCCTCCGGATTCACCTTTATGGAGTATGCGA
TGATTTGGGTCCGCCAGGCTCCAGGGAAGGGTCTAGAGTGGGTCTCAATT
ATTTCTCCGCTTGGTTTGTCTACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAATATCAG
GATTCGTCTGATAGTCAGTATACGAATTTTGACTACTGGGGTCAGGGAAC
CCTGGTCACCGTCTCGAGC

BMS2h-17 (SEQ ID NO: 515)
GAGGTGCAGCTGTTGGAGTCTGGGGGAGGCTTGGTACAGCCTGGGGGGTC
CCTGCGTCTCTCCTGTGCAGCCTCCGGATTCACCTTTGAGGATTATGGGA
TGGGGTGGGCCCGCCAGGCTCCAGGGAAGGGTCTAGAGTGGGTCTCAAGT
ATTGGTCCTCTGGGTCTTTGGACATACTACGCAGACTCCGCGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAATCTCCG
CTTGAGGGTTTGATTACGAATTTTGACTACTGGGGTCAGGGAACCCTGGT
CACCGTCTCGAGC

BMS2h-176 (SEQ ID NO: 516)
GAGGTGCAGCTGTTGGAGTCTGGGGGAGGCTTGGTACAGCCTGGGGGGTC
CCTGCGTCTCTCCTGTGCAGCCTCCGGATTCACCTTTGATGCGTATGAGA
TGGGGTGGGTCCGCCAGGCTCCAGGGAAGGGTCTAGAGTGGGTCTCAATT
ATTGATGGGATGGTAATTCTACATACTACGCAGACTCCGTGAAGGGCCG
GTTCACCATCTCCCGCGACAATTCCAAGAACACGCTGTATCTGCAAATGA
ACAGCCTGCGTGCCGAGGATACCGCGGTATATTACTGTGCGAAACCTGGG
GATAATGTTGGTATTTTTGACTACTGGGGTCAGGGAACCCTGGTCACCGT
CTCGAGC

BMS2h-177 (SEQ ID NO: 517)
GAGGTGCAGCTGTTGGAGTCTGGGGGAGGCTTGGTACAGCCTGGGGGGTC
CCTGCGTCTCTCCTGTGCAGCCTCCGGATTCACCTTTAGTAATTATTATA
TGGTGTGGGTCCGCCAGGCTCCAGGGAAGGGTCTAGAGTGGGTCTCAGCG
ATTGATGAGTGGGGTTTTGCGACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAACATTGG
GAGTTTACGTCTGATACGTCGCGTTTTGACTACTGGGGTCAGGGAACCCT
GGTCACCGTCTCGAGC

BMS2h-178 (SEQ ID NO: 518)
GAGGTGCAGCTGTTGGAGTCTGGGGGAGGCTTGGTACAGCCTGGGGGGTC
CCTGCGTCTCTCCTGTGCAGCCTCCGGATTCACCTTTGAGGATTTTGATA
TGGCTTGGGTCCGCCAGGCTCCAGGGAAGGGTCTAGAGTGGGTCTCATCT
ATTAATGATCAGGGTTCTCTGACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAACCGGAT
CAGTTTTTTGACTACTGGGGTCAGGGAACCCTGGTCACCGTCTCGAGC

BMS2h-179 (SEQ ID NO: 519)
GAGGTGCAGCTGTTGGAGTCTGGGGGAGGCTTGGTACAGCCTGGGGGGTC
CCTGCGTCTCTCCTGTGCAGCCTCCGGATTCACCTTTAGTGCTTATGATA
TGATGTGGGTCCGCCAGGCTCCAGGGAAGGGTCTAGAGTGGGTCTCACGG
ATTAGTCCTCAGGGTCAGCGGACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAAATTCGT
GGGCAGTCGCGGATTCCTATGAGGTTTGACTACTGGGGTCAGGGAACCCT
GGTCACCGTCTCGAGC

BMS2h-18 (SEQ ID NO: 520)
GAGGTGCAGCTGTTGGAGTCTGGGGGAGGCTTGGTACAGCCTGGGGGGTC
CCTGCGTCTCTCCTGTGCAGCCTCCGGATTCACCTTTCCTGAGTATGATA
TGACGTGGGTCCGCCAGGCTCCAGGGAAGGGTCTGGAGTGGGTCTCATAT
ATTAGTTCTGATGGTTATTCTACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAACCGCAT
GGGAGTCCGCGGGAGTTTGACTACTGGGGTCAGGGAACCCTGGTCACCGT
CTCGAGC

BMS2h-180 (SEQ ID NO: 521)
GAGGTGCAGCTGTTGGAGTCTGGGGGAGGCTTGGTACAGCCTGGGGGGTC
CCTGCGTCTCTCCTGTGCAGCCTCCGGATTCACCTTTACGGATTATGAGA
TGGGGTGGGTCCGCCAGGCTCCAGGGAAGGGTCTAGAGTGGGTCTCAACG
ATTACTAGTTTGGGTGAGAGTACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAACCTGGT
CGTATTTTTGACTACTGGGGTCAGGGAACCCTGGTCACCGTCTCGAGC

BMS2h-181 (SEQ ID NO: 522)
GAGGTGCAGCTGTTGGAGTCTGGGGGAGGCTTGGTACAGCCTGGGGGGTC
CCTGCGTCTCTCCTGTGCAGCCTCCGGATTCACCTTTGCTTTTTATCCTA
TGATGTGGGTCCGCCAGGCTCCAGGGAAGGGTCTAGAGTGGGTCTCATGG
ATTGATGCTACGGGTACGAGGACATACTACGCAGACTCCGTGAAGGGCCG
GTTCACCATCTCCCGCGACAATTCCAAGAACACGCTGTATCTGCAAATGA

TABLE 2-continued

Human Anti-CD40L VH Domain Encoding Nucleotide Sequences

ACAGCCTGCGTGCCGAGGACACCGCGGTATATTACTGTGCGGAAGGTAAT
TATGGGAGTTCGTATACTATGGGGGTTTTTGACTACTGGGGTCAGGGAAC
CCTGGTCACCGTCTCGAGC

BMS2h-182 (SEQ ID NO: 523)
GAGGTGCAGCTGTTGGAGTCTGGGGGAGGCTTGGTACAGCCTGGGGGGTC
CCTGCGTCTCTCCTGTGCAGCCTCCGGATTCACCTTTGATGAGTATCCGA
TGTATTGGGTCCGCCAGGCTCCAGGGAAGGGTCTAGAGTGGGTCTCATCG
ATTGGTCCTTCTGGTCCAATACATACTACGCAGACTCCGTGAAGGGCCG
GTTCACCATCTCCCGCGACAATTCCAAGAACACGCTGTATCTGCAAATGA
ACAGCCTGCGTGCCGAGGACACCCGGTATATTACTGTGCGAAATCTCCG
TATTTTGATGTTATTCCTAGTTATTTTGACTACTGGGGTCAGGGAACCCT
GGTCACCGTCTCGAGC

BMS2h-183 (SEQ ID NO: 524)
GAGGTGCAGCTGTTGGAGTCTGGGGGAGGCTTGGTACAGCCTGGGGGGTC
CCTGCGTCTCTCCTGTGCAGCCTCCGGATTCACCTTTGCGGATTACGTA
TGGGTTGGGTCCGCCAGGCTCCAGGGAAGGGTCTAGAGTGGGTCTCATCT
ATTCAGTCGTCGGGTTTGCGGACATACTACGCAGACTCCGTGAAGGGCCG
GTTCACCATCTCCCGCGACAATTCCAAGAACACGCTGTATCTGCAAATGA
ACAGCCTGCGTGCCGAGGATACCGCGGTATATTACTGTGCGAAACGGGCT
AATTCTCGTAGGGGTTTTGACTACTGGGGTCAGGGAACCCTGGTCACCGT
CTCGAGC

BMS2h-184 (SEQ ID NO: 525)
GAGGTGCAGCTGTTGGAGTCTGGGGGAGGCTTGGTACAGCCTGGGGGGTC
CCTGCGTCTCTCCTGTGCAGCCTCCGGATTCACCTTTTCTGATTATGAGA
TGATGTGGGTCCGCCAGGCTCCAGGGAAGGGTCTAGAGTGGGTCTCATCT
ATTACTAGTCATGGTGGGTCTACATACTACGCAGACTCCGTGAAGGGCCG
GTTCACCATCTCCCGCGACAATTCCAAGAACACGCTGTATCTGCAAATGA
ACAGCCTGCGTGCCGAGGATACCGCGGTATATTACTGTGCGAAACCTGAT
AAGGATTTTGACTACTGGGGTCAGGGAACCCTGGTCACCGTCTCGAGC

BMS2h-185 (SEQ ID NO: 526)
GAGGTGCAGCTGTTGGAGTCTGGGGGAGGCTTGGTACAGCCTGGGGGGTC
CCTGCGTCTCTCCTGTGCAGCCTCCGGATTCACCTTTGCGCATTATCCGA
TGTCGTGGGTCCGCCAGGCTCCAGGGAAGGGTCTAGAGTGGGTCTCATCG
ATTGGTAGGCTGGGTAATCGTACATACTACGCAGACTCCGTGAAGGGCCG
GTTCACCATCTCCCGCGACAATTCCAAGAACACGCTGTATCTGCAAATGA
ACAGCCTGCGTGCCGAGGACACCCGGTATATTACTGTGCGAAACGTGCT
ACGCCTGTGCCGATTAAGGGTTTGTTTGACTACTGGGGTCAGGGAACCCT
GGTCACCGTCTCGAGC

BMS2h-186 (SEQ ID NO: 527)
GAGGTGCAGCTGTTGGAGTCTGGGGGAGGCTTGGTACAGCCTGGGGGGTC
CCTGCGTCTCTCCTGTGCAGCCTCCGGACTCACCTTTGGGAGGTATGAGA
TGGCGTGGGTCCGCCAGGCTCCAGGGAAGGGTCTAGAGTGGGTCTCAAGT
ATTGATTCGGATGGTTGGGTGACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGCAACCGGAT
TCGTTGTTTGACTACTGGGGTCAGGGAACCCTGGTCACCGTCTCGAGC

BMS2h-187 (SEQ ID NO: 528)
GAGGTGCAGCTGTTGGAGTCTGGGGGAGGCTTGGTACAGCCTGGGGGGTC
CCTGCGTCTCTCCTGTGCAGCCTCCGGATTCACCTTTTCTAGTTATTCTA
TGGTGTGGGTCCGCCAGGCTCCAGGGAAGGGTCTAGAGTGGGTCTCAGGT
ATTAATCGGGTGGTACTCGTACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAAGGTTGG
AGGAGGGGGTTTGACTACTGGGGTCAGGGAACCCTGGTCACCGTCTCGA
GC

BMS2h-188 (SEQ ID NO: 529)
GAGGTGCAGCTGTTGGAGTCTGGGGGAGGCTTGGTACAGCCTGGGGGGTC
CCTGCGTCTCTCCTGTGCAGCCTCCGGATTCACCTTTACGCGTTATAGGA
TGTCTTGGGTCCGCCAGGCTCCAGGGAAGGGTCTGGAGTGGGTCTCAGGG
ATTTCGAGGGATGGTTATCGGACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAAGGTATG
ACTGCTCGTTTGACTACTGGGGTCAGGGAACCCTGGTCACCGTCTCGA
GC

BMS2h-189 (SEQ ID NO: 530)
GAGGTGCAGCTGTTGGAGTCTGGGGGAGGCTTGGTACAGCCTGGGGGGTC
CCTGCGTCTCTCCTGTGCAGCCTCCGGATTCACCTTTCAGATGTATCCGA
TGGGGTGGGTCCGCCAGGCTCCAGGGAAGGGTCTAGAGTGGGTCTCAATG
ATTGAGCCGGCTGGTGATCTTACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAATATCAG
GAGCAGCCTTGGTTTGACTACTGGGGTCAGGGAACCCTGGTCACCGTCTC
GAGC

BMS2h-19 (SEQ ID NO: 531)
GAGGTGCAGCTGTTGGAGTCTGGGGGAGGCTTGGTACAGCCTGGGGGGTC
CCTGCGTCTCTCCTGTGCAGCCTCCGGATTCCCCTTTCCGCAGTATCAGA
TGGCGTGGGTCCGCCAGGCTCCAGGGAAGGGTCTAGAGTGGGTCTCAATG
ATTACTTCTGATGGTCTTGATACATATTACGCAGACTCCGTGAAGGGCCG
GTTCACCATCTCCCGCGACAATTCCAAGAACACGCTGTATCTGCAAATGA
ACAGCCTGCGTGCCGAGGATACCGCGGTATATTACTGTGCGAAACCTGAG
CCTCTTTTTGACTACTGGGGTCAGGGAACCCTGGTCACCGTCTCGAGC

BMS2h-190 (SEQ ID NO: 532)
GAGGTGCAGCTGTTGGAGTCTGGGGGAGGCTTGGTACAGCCTGGGGGGTC
CCTGCGTCTCTCCTGTGCAGCCTCCGGATTCACCTTTAGTATGTATGATA
TGCATTGGGTCCGCCAGGCTCCAGGGAAGGGTCTAGAGTGGGTCTCAACG
ATTTTGTCTGATGGTACGGATACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAATATGGG
GCTATGTTTGACTACTGGGGTCAGGGAACCCTGGTCACCGTCTCGAGC

BMS2h-191 (SEQ ID NO: 533)
GAGGTGCAGCTGTTGGAGTCTGGGGGAGGCTTGGTACAGCCTGGGGGGTC
CCTGCGTCTCTCCTGTGCAGCCTCCGGATTCACCTTTAAGTTGTATCGCA
TGACGTGGGTCCGCCAGGCTCCAGGGAAGGGTCTAGAGTGGGTCTCATCT
ATTGATGCGGGGGGTCATGAGACATACTACGCAGACTCCGTGAAGGGCCG
GTTCACCATCTCCCGCGACAATTCCAAGAACACGCTGTATCTGCAAATGA
ACAGCCTGCGTGCCGAGGATACCGCGGTATATTACTGTGCGAAAGATTGG
TGGGATTATCTGTTTGACTACTGGGGTCAGGGAACCCTGGTCACCGTCTC
GAGC

BMS2h-192 (SEQ ID NO: 534)
GAGGTGCAGCTGTTGGAGTCTGGGGGAGGCTTGGTACAGCCTGGGGGGTC
CCTGCGTCTCTCCTGTGCAGCCTCCGGATTCACCTTTTCGCGGTATCCGA
TGAGTTGGGTCCGCCAGGCTCCAGGGAAGGGTCTAGAGTGGGTCTCATCT
ATTAATCGTTCGGGTATGCGGACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAGGGCAT
CAGGCGCCGTTTGACTACTGGGGTCAGGGAACCCTGGTCACCGTCTCGA
GC

BMS2h-193 (SEQ ID NO: 535)
GAGGTGCAGCTGTTGGAGTCTGGGGGAGGCTTGGTACAGCCTGGGGGGTC
CCTGCGTCTCTCCTGTGCAGCCTCCGGATTCACCTTTACGGGGTATGCTA
TGTCTTGGGTCCGCCAGGCTCCAGGGAAGGGTCTAGAGTGGGTCTCAACT
ATTAATGCGAATGGTATTCGGACATACTACGCCGACTCCGTGAAGGGCCG
GTTCACCATCTCCCGCGACAATTCCAAGAACACGCTGTATCTGCAAATGA
ACGGCCTGCGTGCCGAGGACACCGCGGTATATTACTGTGCGAAAGGGGG
GTTTGGAGGTGGGGACTGGGCATAAGTTTGACTACTGGGGTCAGGGAAC
CCTGGTCACCGTCTCGAGC

BMS2h-194 (SEQ ID NO: 536)
GAGGTGCAGCTGTTGGAGTCTGGGGGAGGCTTGGTACAGCCTGGGGGGTC
CCTGCGTCTCTCCTGTGCAGCCTCCGGATTCACCTTTAAGCAGTATGATA
TGCGGTGGGTCCGCCAGGCTCCAGGGAAGGGTCTAGAGTGGGTCTCAACG
ATTTCGCAGAATGGTACTAAGACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAATCGAGG
ACTGTAGGTATTTTGACTACTGGGGTCAGGGAACCCTGGTCACCGTCTC
GAGC

BMS2h-195 (SEQ ID NO: 537)
GAGGTGCAGCTGTTGGAGTCTGGGGGAGGCTTGGTACAGCCTGGGGGGTC
CCTGCGTCTCTCCTGTGCAGCCTCCGGATTCACCTTTGGGACTTATGATA
TGGGGTGGGTCCGCCAGGCTCCAGGGAAGGGTCTAGAGTGGGTCTCAAGG
ATTAATTGGGATGATCGTACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAAGCGGG
TTTGGTCATTATGTTGATGGTCTTGGGTTTGACTACTGGGGTCAGGGAAC
CCTGGTCACCGTCTCGAGC

BMS2h-196 (SEQ ID NO: 538)
GAGGTGCAGCTGTTGGAGTCTGGGGGAGGCTTGGTACAGCCTGGGGGGTC
CCTGCGTCTCTCCTGTGCAGCCTCCGGATTCACCTTTAGTGGGTATGAGA
TGGCGTGGGTCCGCCAGGCTCCAGGGAAGGGTCTAGAGTGGGTCTCATCT

TABLE 2-continued

Human Anti-CD40L VH Domain Encoding Nucleotide Sequences

ATTACTGATATGGGTGATTCTACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAACCTGGG
ACTGCGTTTGACTACTGGGGTCCGGGAACCCTGGTCACCGTCTCGAGC

BMS2h-197 (SEQ ID NO: 539)
GAGGTGCAGCTGTTGGAGTCTGGGGGAGGCTTGGTACAGCCTGGGGGGTC
CCTGCGTCTCTCCTGTGCAGCCTCCGGATTCACCTTTGCGAAGTATAAGA
TGTGGTGGGTCCGCCAGGCTCCAGGGAAGGGTCTAGAGTGGGTCTCAAGT
ATTACTCCGAAGGGTCATTCTACATACTACGCAGACTCCGTGAAGGGCCG
GTTCACCATCTCCCGCGACAATTCCAAGAACACGCTGTATCTGCAAATGA
ACAGCCTGCGTGCCGAGGATACCGCGGTATATTACTGTGCGAAAAGGCCG
ATGACTCCGTTTGACTACTGGGGTCAGGGAACCCTGGTCACCGTCTCGA
GC

BMS2h-198 (SEQ ID NO: 540)
GAGGTGCAGCTGTTGGAGTCTGGGGGAGGCTTGGTACAGCCTGGGGGGTC
CCTGCGTCTCTCCTGTGCAGCCTCCGGATTCACCTTTGAGCGGTATAATA
TGTCTTGGGTCCGCCAGGCTCCAGGGAAGGGTCTAGAGTGGGTCTCATCT
ATTCGGCCGCGGGGTGGGAAGACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAATGCGG
CGGGAGGGGTATACTGGTTCTAAGTTTGACTACTGGGGTCAGGGAACCCT
GGTCACCGTCTCGAGC

BMS2h-199 (SEQ ID NO: 541)
GAGGTGCAGCTGTTGGAGTCTGGGGGAGGCTTGGTACAGCCTGGGGGGTC
CCTGCGTCTCTCCTGTGCAGCCTCCGGATTCACCTTTGAGAGGTATGGTA
TGACTTGGGTCCGCCAGGCTCCAGGGAAGGGTCTGGAGTGGGTCTCAAGT
ATTTGGCCGAGGGGTCAGAAGACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAAGGGAAT
AGTCGGTATGTTTTTGACTACTGGGGTCAGGGAACCCTGGTCACCGTCTC
GAGC

BMS2h-2 (SEQ ID NO: 542)
GAGGTGCAGCTGTTGGAGTCTGGGGGAGGCTTGGTACAGCCTGGGGGGTC
CCTGCGTCTCTCCTGTGCAGCCTCCGGATTCACCTTTTCTGATTATGAGA
TGATGTGGGTCCGCCAGGCTCCAGGGAAGGGTCTAGAGTGGGTCTCAACT
ATTACTTCGGATGGTATTTCTACATACTACGCAGACTCCGTGAAGGGCCG
GTTCACCATCTTCCGCGACAATTCCAAGAACACGCTGTATCTGCAAATGA
ACAGCCTGCGTGCCGAGGATACCGCGGTATATTACTGTGCGAAAAGTGGG
AGGTTTTTTGACTACTGGGGTCAGGGAACCCTGGTCACCGTCTCGAGC

BMS2h-20 (SEQ ID NO: 543)
GAGGTGCAGCTGTTGGAGTCTGGGGGAGGCTTGGTACAGCCTGGGGGGTC
CCTGCGTCTCTCCTGTGCAGCCTCCGGATTCACCTTTTCGGTTATCAGA
TGGCTTGGGTCCGCCAGGCTCCAGGGAAGGGTCTAGAGTGGGTCTCAGGT
ATTAGTTCGGAGGGTCTTACTACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAATTGGG
CGTAGGTTTGACTACTGGGGTCAGGGAACCCTGGTCACCGTCTCGAGC

BMS2h-200 (SEQ ID NO: 544)
GAGGTGCAGCTGTTGGAGTCTGGGGGAGGCTTGGTACAGCCTGGGGGGTC
CCTGCGTCTCTCCTGTGCAGCCTCCGGATTCACCTTTACTAATTATAGTA
TGGGTTGGGTCCGCCAGGCTCCAGGGAAGGGTCTAGAGTGGGTCTCAACT
ATTCGTCCTAATGGTACTAAGACATACTACGCAGACTCCGTGAAGGGCCG
GTTCACCATCTCCCGCGACAATTCCAAGAACACGCTGTATCTGCAAATGA
ACAGCCTGCGTGCCGAGGATACCGCGGTATATTACTGTGCGAAACGGTCG
TCTGCGCATCTTCAGAGGTTTGACTACTGGGGTCAGGGAACCCTGGTCAC
CGTCTCGAGC

BMS2h-201 (SEQ ID NO: 545)
GAGGTGCAGCTGTTGGAGTCTGGGGGAGGCTTGGTACAGCCTGGGGGGTC
CCTGCGTCTCTCCTGTGCAGCCTCCGGATTCACCTTTGGTAATTATTCGA
TGGGTTGGGTCCGCCAGGCTCCAGGGAAGGGTCTAGAGTGGGTCTCATCG
ATTGGTCGTCATGGTGGCGTATACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAAAGGGG
AGTACTTATCCTAGGTTTGACTACTGGGGTCAGGGAACCCTGGTCACCGT
CTCGAGC

BMS2h-202 (SEQ ID NO: 546)
GAGGTGCAGCTGTTGGAGTCTGGGGGAGGCTTGGTACAGCCTGGGGGGTC
CCTGCGTCTCTCCTGTACAGCCTCCGGATTCACCTTTTCGCATTATGAGA
TGGGGTGGGTCCGCCAGGCTCCAGGGAAGGGTCTAGAGTGGGTCTCAAGT

ATTGAGCCTTTTGGTGGTGGGACATACTACGCAGACTCCGTGAAGGGCCG
GTTCACCATCTCCCGCGACAATTCCAAGAACACGCTGTATCTGCAAATGA
ACAGCCTGCGTGCCGAGGATACCGCGGTATATTACTGTGCGAAAGTGTAT
CCTCAGGGTTCTTTTGACTACTGGGGTCAGGGAACCCTGGTCACCGTCTC
GAGC

BMS2h-203 (SEQ ID NO: 547)
GAGGTGCAGCTGTTGGAGTCTGGGGGAGGCTTGGTACAGCCTGGGGGGTC
CCTGCGTCTCTCCTGTGCAGCCTCCGGATTCACCTTTAGTAATTATACTA
TGGGGTGGGTCCGCCAGGCTCCAGGGAAGGGTCTAGAGTGGGTCTCATCT
ATTCGGCCTGATGGTAAGATTACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGGAAGTTTAT
TCTTCGTGCGATGTGTACTCCGCTTTTGTTTGACTACTGGGGTCAGGG
AACCCTGGTCACCGTCTCGAGC

BMS2h-204 (SEQ ID NO: 548)
GAGGTGCAGCTGTTGGAGTCTGGGGGGAGGCTTGGTACAGCCTGGGGGGTC
CCTGCGTCTCTCCTGTGCAGCCTCCGGATTCACCTTTAAGCGGTATTCGA
TGGCGTGGGTCCGCCAGGCTCCAGGGAAGGGTCTAGAGTGGGTCTCAGAT
ATTGGGCCGAGGGGTTTTTCGACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAAGTGGGT
CGTGGTCAGCGTGATACTAGTCAGCCGTTTGACTACTGGGGTCAGGGAAC
CCTGGTCACCGTCTCGAGC

BMS2h-205 (SEQ ID NO: 549)
GAGGTGCAGCTGTTGGAGTCTGGGGGAGGCTTGGTACAGCCTGGGGGGTC
CCTGCGTCTCTCCTGTGCAGCCTCCGGATTCACCTTTGCTTCTTATCAGA
TGGCTTGGGTCCGCCAGGCTCCAGGGAAGGGTCTAGAGTGGGTCTCAGGG
ATTACTTCGGGTGGTCTTAGTACGTACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAACCGGGG
AGGGGTTTTGACTACTGGGGTCAGGGAACCCTGGTCACCGTCTCGAGC

BMS2h-206 (SEQ ID NO: 550)
GAGGTGCAGCTGTTGGAGTCTGGGGGAGGCTTGGTACAGCCTGGTGGGTC
CCTGCGTCTCTCCTGTGCAGCCTCCGGATTCACCTTTGCTTCTTATGAGA
TGACTTGGGTCCGCCAGGCTCCAGGGAAGGGTCTAGAGTGGGTCTCAGGG
ATTTCTTCTGATGGTCTGCTCTACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAACCGGGG
GTGTTGTTTGACTACTGGGGTCAGGGAACCCTGGTCACCGTCTCGAGC

BMS2h-207 (SEQ ID NO: 551)
GAGGTGCAGCTGTTGGAGTCTGGGGGAGGCTTGGTACAGCCTGGGGGGTC
CCTGCGTCTCTCCTGTGCAGCCTCCGGATTCACCTTTGATAAGTATTTGA
TGTCGTGGGTCCGCCAGGCTCCAGGGAAGGGTCTGGAGTGGGTCTCAGGT
ATTGAGCCTCTGGGTGATGTTACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAAGAGGCT
TCGGGGGATTTTGACTACTGGGGTCAGGGAACCCTGGTCACCGTCTCGA
GC

BMS2h-208 (SEQ ID NO: 552)
GAGGTGCAGCTGTTGGAGTCTGGGGGAGGCTTGGTACAGCCTGGGGGGTC
CCTGCGTCTCTCCTGTGCAGCCTCCGGGTTCACCTTTACTGAGTATGAGA
TGTCTTGGGTCCGCCAGGCTCCAGGGAAGGGTCTAGAGTGGGTCTCAAGT
ATTGATAATGTGGGTAGTAGTACATACTACGCAGACTCCGTGAAGGGCCG
GTTCACCATCTCCCGCGACAATTCCAAGAACACGCTGTATCTGCAAATGA
ACAGCCTGCGTGCCGAGGATACCGCGGTATATTACTGTGCGAAACCTGGG
AAGCTTTTTGACTACTGGGGTCAGGGAACCCTGGTCACCGTCTCGAGC

BMS2h-209 (SEQ ID NO: 553)
GAGGTGCAGCTGTTGGAGTCTGGGGGAGGCTTGGTACAGCCTGGGGGGTC
CCTGCGTCTCTCCTGTGCAGCCTCCGGATTCACCTTTGCTGATTATGAGA
TGGTGTGGGTCCGCCAGGCTCCAGGGAAGGGTCTAGAGTGGGTCTCAGCG
ATTTCTAGGCAGGGTTTTGCTACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAAGATCTG
GAGCGGGATGATTTTGACTACTGGGGTCAGGGAACCCTGGTCACCGTCTC
GAGC

BMS2h-21 (SEQ ID NO: 554)
GAGGTGCAGCTGTTGGAGTCTGGGGGAGGCTTGGTACAGCCTGGGGGGTC
CCTGCGTCTCTCCTGTGCAGCCTCCGGATTCACCTTTGCGAATTATGAGA
TGGGGTGGGCCCGCCAGGCTCCAGGGAAGGGTCTAGAGTGGGTCTCAGTT

TABLE 2-continued

Human Anti-CD40L VH Domain Encoding Sequences

ATTTCTGAGTGGGGTTATTCTACATACTACGCAGACTCCGCGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAACTTGTG
GGTGGGACTCAGTATGAGTTTGACTACTGGGGTCAGGGAACCCTGGTCAC
CGTCTCGAGC

BMS2h-22 (SEQ ID NO: 555)
GAGGTGCAGCTGTTGGAGTCTGGGGGAGGCTTGGTACAGCCTGGGGGGTC
CCTGCGTCTCTCCTGTGCAGCCTCCGGATTCACCTTTCATAATTATGAGA
TGTCGTGGGTCCGCCAGGCTCCAGGGAAGGGTCTAGAGTGGGTCTCAAGT
ATTTCTTCGGGTGGTTCTTCTACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAACCGGGG
GTTAAGTTTGACTACTGGGGTCAGGGAACCCTGGTCACCGTCTCGAGC

BMS2h-23 (SEQ ID NO: 556)
GAGGTGCAGCTGTTGGAGTCCGGGGGAGGCTTGGTACAGCCTGGGGGGTC
CCTGCGTCTCTCCTGTGCAGCCTCCGGATTCACCTTTGGGCGTGTATGAGA
TGACGTGGGTCCGCCAGGCTCCAGGGAAGGGTCTAGAGTGGGTCTCAAGT
ATTACGGGTGATGGTATTTCGACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAAGCTGGG
AGGAAGTTTGACTACTGGGGTCAGGGAACCCTGGTCACCGTCTCGAGC

BMS2h-24 (SEQ ID NO: 557)
GAGGTGCAGCTGTTGGAGTCTGGGGGAGGCTTGGTACAGCCTGGGGGGTC
CCTGCGTCTCTCCTGTGCAGCCTCCGGATTCACCTTTAGTAATTATCAGA
TGGCGTGGGTCCGCCAGGCTCAGGGAAGGGTCTAGAGTGGGTCTCAAGT
ATTACTAGTGAGGGTGGTTCGACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAACGGGT
AAGAATTTTGACTACTGGGGTCAGGGAACCCTGGTCACCGTCTCGAGC

BMS2h-24-1 (SEQ ID NO: 558)
GAGGTGCAGCTGTTGGAGTCTGGGGGAGGCTTGGTACAGCCTGGGGGGTC
CCTGCGTCTCTCCTGTGCAGCCTCCGGATTCACCTTTAGTGATTATCAGA
TGGCGTGGGTTCGCCAGGCTCCAGGGAAGGGACTAGAGTGGGTCTCAAGT
ATTACTAGTGAGGGTGGTTCGACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAACCGGGT
AAGAATTTCGACTACTGGGGTCAGGGAACCCTGGTCACCGTCTCGAGC

BMS2h-25 (SEQ ID NO: 559)
GAGGTGCAGCTGTTGGAGTCTGGGGGAGGCTTGGTACAGCCTGGGGGGTC
CCTGCGTCTCTCCTGTGCAGCCTCCGGATTCACCTTTGATAATTATGAGA
TGACGTGGGTCCGCCAGGCTCCAGGGAAGGGTCTAGAGTGGGTCTCAACT
ATTACGTCGCAGGGTACTAGTACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAACCTGAT
CGTTCTTTTGACTACTGGGGTCAGGGAACCCTGGTCACCGTCTCGAGC

BMS2h-26 (SEQ ID NO: 560)
GAGGTGCAGCTGTTGGAGTCTGGGGGAGGCTTGGTACAGCCTGGGGGGTC
CCTGCGTCTCTCCTGTGCAGCCTCCGGATTCACCTTTCGTAGTTATGAGA
TGACTTGGGTCCGCCAGGCTCCAGGGAAGGGTCTGGAGTGGGTCTCATCT
ATTACGTCGGATGGTGGTACTACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAACCTGAT
AAGACGTTTGACTACTGGGGTCAGGGAACCCTGGTCACCGTCTCGAGC

BMS2h-27 (SEQ ID NO: 561)
GAGGTGCAGCTGTTGGAGTCTGGGGGAGGCTTGGTACAGCCTGGGGGGTC
CCTGCGTCTCTCCTGTGCAGCCTCCGGATTCACCTTTAATTTGTATGAGA
TGACTTGGGTCCGCCAGGCTCCAGGGAAGGGTCTAGAGTGGGTCTCATCT
ATTACTAGTGATGGTGTTTCTACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAACCGGAT
TCTCCGTTTGACTACTGGGGTCAGGGAACCCTGGTCACCGTCTCGAGC

BMS2h-28 (SEQ ID NO: 562)
GAGGTGCAGCTGTTGGAGTCTGGGGGAGGCTTGGTACAGCCTGGGGGGTC
CCTGCGTCTCTCCTGTGCAGCCTCCGGATTCACCTTTGGGCATTATGATA
TGGCTTGGGTCCGCCAGGCTCCAGGGAAGGGTCTAGAGTGGGTCTCAACT
ATTAGTGATAATGGTAATGGGACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAACCGGGG
CGTGATTTTGACTACTGGGGTCAGGGAACCCTGGTCACCGTCTCGAGC

BMS2h-29 (SEQ ID NO: 563)
GAGGTGCAGCTGTTGGAGTCTGGGGGAGGCTTGGTACAGCCTGGGGGGTC
CCTGCGTCTCTCCTGTGCAGCCTCCGGATTCACCTTTGGTCGTTATCAGA
TGGCTTGGGTCCGCCAGGCTCCAGGGAAGGGTCTAGAGTGGGTCTCATCT
ATTTCTTCTGATGGTGGGGGGACATACTACGCAGACTCCGTGAAGGGCCG
GTTCACCATCTCCCGCGACAATTCCAAGAACACGCTGTATCTGCAAATGA
ACAGCCTGCGTGCCGAGGATACCGCGGTATATTACTGTGCGAAACCTGGG
CGGGGCGTTTGACTACTGGGGTCAGGGAACCCTGGTCACCGTCTCGAGC

BMS2h-30 (SEQ ID NO: 564)
GAGGTGCAGCTGTTGGAGTCTGGGGGAGGCTTGGTACAGCCTGGGGGGTC
CCTGCGTCTCTCCTGTGCAGCCTCCGGATTCACCTTTGCGAGGTATCAGA
TGGCTTGGGTCCGCCAGGCTCCAGGGAAGGGTCTGGAGTGGGTCTCAACT
ATTTCTGATGATGGTGATTCGACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAACTGGAT
AAGTTGTTTGACTACTGGGGTCAGGGAACCCTGGTCACCGTCTCGAGC

BMS2h-300 (SEQ ID NO: 565)
GAGGTGCAGCTGTTGGAGTCTGGGGGAGGCTTGGTACAGCCTGGGGGGTC
CCTGCGTCTCTCCTGTGCAGCCTCCGGATTCACCTTTGATAATGATGAGA
TGACGTGGGTCCGCCAGGCTCCAGGGAAGGGTCTAGAGTGGGTCTCAGCT
ATTGATACGACGGGTGGGCAGACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAACCTGGT
AAGGAGTTTGACTACTGGGGTCAGGGAACCCTGGTCACCGTCTCGAGC

BMS2h-301 (SEQ ID NO: 566)
GAGGTGCAGCTGTTGGAGTCTGGGGGAGGCTTGGTACAGCCTGGGGGGTC
CCTGCGTCTCTCCTGTGCAGCCTCCGGATTCACCTTTGGGGAGAGTGAGA
TGAGTTGGGTCCGCCAGGCTCCAGGGAAGGGTCTAGAGTGGGTCTCAAGT
ATTCTTGATGAGGGTTCTGGGACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAACCTGAT
AAGGATTTTGACTACTGGGGTCAGGGAACCCTGGTCACCGTCTCGAGC

BMS2h-302 (SEQ ID NO: 567)
GAGGTGCAGCTGTTGGAGTCTGGGGGAGGCTTGGTACAGCCTGGGGGGTC
CCTGCGTCTCTCCTGTGCAGCCTCCGGATTCACCTTTGGGGAGGAGAGA
TGAGTTGGGTCCGCCAGGCTCCAGGGAAGGGTCTAGAGTGGGTCTCAGCG
ATTACTGATGATGGTGATGATACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAACCTAAT
GCGGGTGCTTTTGACTACTGGGGTCAGGGAACCCTGGTCACCGTCTCGA
GC

BMS2h-303 (SEQ ID NO: 568)
GAGGTGCAGCTGTTGGAGTCTGGGGGAGGCTTGGTACAGCCTGGGGGGTC
CCTGCGTCTCTCCTGTGCAGCCTCCGGATTCACCTTTGAGGTGTATGATA
TGGCTTGGGTCCGCCAGGCTCCAGGGAAGGGTCTAGAGTGGGTCTCAGGG
ATTGTTAATGATGGTTCTTCTACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAACCTGAT
AAGGATTTTGACTACTGGGGTCAGGGAACCCTGGTCACCGTCTCGAGC

BMS2h-304 (SEQ ID NO: 569)
GAGGTGCAGCTGTTGGAGTCTGGGGGAGGCTTGGTACAGCCTGGGGGGTC
CCTGCGTCTCTCCTGTGCAGCCTCCGGATTCACCTTTGTTAATACGGAGA
TGACTTGGGTCCGCCAGGCTCCAGGGAAGGGTCTAGAGTGGGTCTCATCG
ATTGCGGATGATGGTTCTAGTACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAACCTGGT
CAGGCTTTTGACTACTGGGGTCAGGGAACCCTGGTCACCGTCTCGAGC

BMS2h-31 (SEQ ID NO: 570)
GAGGTGCAGCTGTTGGAGTCTGGGGGAGGCTTGGTACAGCCTGGGGGGTC
CCTGCGTCTCTCCTGTGCAGCCTCCGGATTCACCTTTGAGGAGTATGAGA
TGGCGTGGGTCCGCCAGGCTCCAGGGAAGGGTCTAGAGTGGGTCTCAACG
ATTTCGGATGATGGTTCTTCGACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAACCTGAT
CTTTATTTTGACTACTGGGGTCAGGGAACCCTGGTCACCGTCTCGAGC

BMS2h-32 (SEQ ID NO: 571)
GAGGTGCAGCTGTTGGAGTCTGGGGGAGGCTTGGTACAGCCTGGGGGGTC
CCTGCGTCTCTCCTGTGCAGCCTCCGGATTCACCTTTGAGGTGTATCAGA

TABLE 2-continued

Human Anti-CD40L VH Domain Encoding Sequences

TGGGTTGGGTCCGCCAGGCTCCAGGGAAGGGTCTAGAGTGGGTCTCATTT
ATTGTGCCTGGGGGTGATTTGACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAACGTGG
CCGGAGTTTGACTACTGGGGTCAGGGAACCCTGGTCACCGTCTCGAGC

BMS2h-4 (SEQ ID NO: 572)
GAGGTGCAGCTGTTGGAGTCTGGGGGAGGCTTGGTACAGCCTGGGGGGTC
CCTGCGTCTCTCCTGTGCAGCCTCCGGATTCACCTTTGATAATTATGAGA
TGACGTGGGTCCGCCAGGCTCCAGGGAAGGGTCTAGAGTGGGTCTCATCT
ATTACGAGTGATGGTACTTCGACATACTACGCAGACTCCGTGAAGGGCCG
GTTCACCATCTCCCGCGACAATTCCAAGAACACGCTGTATCTGCAAATGA
ACAGCCTGCGTGCCGAGGATACCGCGGTATATTACTGTGCGAAACCTAAT
CCGCCGTTTGACTACTGGGGTCAGGGAACCCTGGTCACCGTCTCGAGC

BMS2h-40 (SEQ ID NO: 573)
GAGGTGCAGCTGTTGGAGTCTGGGGGAGGCTTGGTACAGCCTGGGGGGTC
CCTGCGTCTCTCCTGTGCAGCCTCCGGATTCACCTTTAAGGCGTATGATA
TGGGTTGGGTCCGCCAGGCTCCAGGGAAGGGTCTAGAGTGGGTCTCACAG
ATTGGGAGGGATGGTTCTTTTACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAACCTCGT
CGGTATGCTATTTTTACTTTTGATCGGGGTCAGGGAACCCTGGTCACCGT
CTCGAGC

BMS2h-400 (SEQ ID NO: 574)
GAGGTGCAGCTGTTGGAGTCTGGGGGAGGCTTGGTACAGCCTGGGGGGTC
CCTGCGTCTCTCCTGTGCAGCCTCCGGATTCACCTTTAAGCAGTATCCGA
TGGTGTGGGTCCGCCAGGCTCCAGGGAAGGGTCTAGAGTGGGTCTCAACG
ATTTCTACTAATGGTGTGAGGACATACTACGCAGACTCCGTGAAGGGCCG
GTTCACCATCTCCCGCGACAATTCCAAGAACACGCTGTATCTGCAAATGA
ACAGCCTGCGTGCCGAGGATACCGCGGTATATTACTGTGCGAAATGGACG
GATATTATTTCGTCTTCGGAGTTTGACTACTGGGGTCAGGGAACCCTGGT
CACCGTCTCGAGC

BMS2h-401 (SEQ ID NO: 575)
GAGGTGCAGCTGTTGGAGTCTGGGGGAGGCTTGGTACAGCCTGGGGGGTC
CCTGCGTCTCTCCTGTGCAGCCTCCGGATTCACCTTTTTTAATTATGATA
TGTCTTGGGTCCGCCAGGCTCCAGGGAAGGGTCTAGAGTGGGTCTCAGCT
ATTAGTGGTAGTGGTGGTAGCACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAAGTTTTT
GTGTGGTCGGCTGATATTGATTTTGATTTGACTACTGGGGTCAGGGAAC
CCTGGTCACCGTCTCGAGC

BMS2h-402 (SEQ ID NO: 576)
GAGGTGCAGCTGTTGGAGTCTGGGGGAGGCTTGGTACAGCCTGGGGGGTC
CCTGCGTCTCTCCTGTGCAGCCTCCGGATTCACCTTTTCGTGGTATGATA
TGAGTTGGGTCCGCCAGGCTCCAGGGAAGGGTCTAGAGTGGGTCTCACAT
ATTGCGAGTTGGGGTGGTAAGACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAAGTGACG
GTGAAGGATGGGGGTATCTGATGGATTTTGACTACTGGGGTCAGGGAAC
CCTGGTCACCGTCTCGAGC

BMS2h-403 (SEQ ID NO: 577)
GAGGTGCAGCTGTTGGAGTCTGGGGGAGGCTTGGTACAGCCTGGGGGGTC
CCTGCGTCTCTCCTGTGCAGCCTCCGGATTCACCTTTGCTGAGTATGCTA
TGGCGTGGGTCCGCCAGGCTCCAGGGAAGGGTCTGGAGTGGGTCTCAAGT
ATTGGGCGGGATGGTGCGGTGACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAATGAAG
GCGGCGAAGGAGCGGGGTTCTTGGTTTGACTACTGGGGTCAGGGAACCCT
GGTCACCGTCTCGAGC

BMS2h-404 (SEQ ID NO: 578)
GAGGTGCAGCTGTTGGAGTCTGGGGGAGGCTTGGTACAGCCTGGGGGGTC
CCTGCGTCTCTCCTGTGCAGCCTCCGGATTCACCTTTCAGGCTTATCGA
TGCAGTGGGTCCGCCAGGCTCCAGGGAAGGGTCTTGAGTGGGTCTCAACT
ATTAGTCCTAATGGTCTTTTTACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAATGGTTG
AGTTCTTTTGACTGGGGTCAGGGAACCCTGGTCACCGTCTCGAGC

BMS2h-407 (SEQ ID NO: 579)
GAGGTGCAGCTGTTGGAGTCTGGGGGAGGCTTGGTACAGCCTGGGGGGTC
CCTGCGTCTCTCCTGTGCAGCCTCCGGATTCACCTTTGCTATGTATTCGA

TGGCTTGGGTCCGCCAGGCTCCAGGGAAGGGTCTAGAGTGGGTCTCAGGT
ATTTCGCCTCGTGGTGTTGAGACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAAACTAAT
TGGAATGGTGTGGATCTGTTTGACTACTGGGGTCAGGGAACCCTGGTCAC
CGTCTCGAGC

BMS2h-408 (SEQ ID NO: 580)
GAGGTGCAGCTGTTGGAGTCTGGGGGAGGCTTGGTACAGCCTGGGGGGTC
CCTGCGTCTCTCCTGTGCAGCCTCCGGATTCACCTTTCCTACGTATATGA
TGAGTTGGGTCCGCCAGGCTCCAGGGAAGGGTCTAGAGTGGGTCTCAACT
ATTAATACGAATGGTCGTGATACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAAGGGGAT
AGTAATATGTCGTTTTTTGACTACTGGGGTCAGGGAACCCTGGTCACCGT
CTCGAGC

BMS2h-409 (SEQ ID NO: 581)
GAGGTGCAGCTGTTGGAGTCTGGGGGAGGCTTGGTACAGCCTGGGGGGT
CCCTGCGTCTCTCCTGTGCAGCCTCCGGATTCACCTTTGAGGGTTATTC
GATGACGTGGGTCCGCCAGGCTCCAGGGAAGGGTCTAGAGTGGGTCTCA
TCTATTAATGCGTCGGGTACTCTGACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
GATGGTAATAGGTCTGAGGTTTTTTTTGACTACTGGGGTCAGGGAACCC
TGGTCACCGTCTCGAGC

BMS2h-41 (SEQ ID NO: 582)
GAGGTGCAGCTGTTGGAGTCTGGGGGAGGCTTGGTACAGCCTGGGGGGT
CCCTGCGTCTCTCCTGTGCAGCCTCCGGATTCACCTTTTTTTGAGTATGA
GATGACGTGGGTCCGCCAGGCTCCAGGGAAGGGTCTAGAGTGGGTCTCA
TCTATTGCGAATGATGGTTCGACTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
CCTGATCGGCAGTTTGACTACTGGGGTCAGGGAACCCTGGTCACCGTCT
CGAGC

BMS2h-410 (SEQ ID NO: 583)
GAGGTGCAGCTGTTGGAGTCTGGGGGAGGCTTGGTACAGCCTGGGGGGT
CCCTGCGTCTCTCCTGTGCAGCCTCCGGATTCACCTTTCAGGATTATTT
GATGCGTGGGTCCGCCAGGCTCCAGGGAAGGGTCTAGAGTGGGTCTCA
GAGATTAATCAGGATGGTACTGTTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGGAA
AGTTCTCCGTATTTTGACTACTGGGGTCAGGGAACCCTGGTCACCGTCT
CGAGC

BMS2h-411 (SEQ ID NO: 584)
GAGGTGCAGCTGTTGGAGTCTGGGGGAGGCTTGGTACAGCCTGGGGGGT
CCCTGCGTCTCTCCTGTGCAGCCTCCGGATTCACCTTTGATAATTATGC
GATGTCGTGGGTCCGCCAGGCTCCAGGGAAGGGTCTAGAGTGGGTCTCA
TCTATTAGTCGGGATGGTCATGTGACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
CTTTCTTCTAAGGGGGGACGTTTGCTAGTTCTTTTGACTACTGGGGTC
AGGGAACCCTGGTCACCGTCTCGAGC

BMS2h-412 (SEQ ID NO: 585)
GAGGTGCAGCTGTTGGAGTCTGGGGGAGGCTTGGTACAGCCTGGGGGGT
CCCTGCGTCTCTCCTGTGCAGCCTCCGGATTCACCTTTAGTGCTGTTCC
GATGACGTGGGTCCGCCAGGCTCCAGGGAAGGGTCTAGAGTGGGTCTCA
GCGATTACGGATGATGGTCTTCGTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
GGTCATATTTATGGGGATTATTTTGACTACTGGGGTCAGGGAACCCTGG
TCACCGTCTCGAGC

BMS2h-413 (SEQ ID NO: 586)
GAGGTGCAGCTGTTGGAGTCTGGGGGAGGCTTGGTACAGCCTGGGGGGT
CCCTGCGTCTCTCCTGTGCAGCCTCCGGATTCACCTTTGAGCTTTATAG
GATGATGTGGGTCCGCCAGGCTCCAGGGAAGGGTCTAGAGTGGGTCTCA
GCTATTAGTAGTGATGGTGATACTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGGAA
CATTGGTTGGGTACTACGTTGTCTTTGAGGGATTTTGACTACTGGGGTC
AGGGAACCCTGGTCACCGTCTCGAGC

TABLE 2-continued

Human Anti-CD40L VH Domain Encoding Nucleotide Sequences

BMS2h-414 (SEQ ID NO: 587)
GAGGTGCAGCTGTTGGAGTCTGGGGGAGGCTTGGTACAGCCTGGGGGGT
CCCTGCGTCTCTCCTGTGCAGCCTCCGGATTCACCTTTTATCGTTATAC
GATGGCGTGGGTCCGCCAGGCTCCAGGGAAGGGTCTAGAGTGGGTCTCA
CAGATTTCGCCTAGGGGTAATATTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
AGTGGTGTGGCGGGGCGGAGTCGCCTGAGTATTTTGACTACTGGGGTC
AGGGAACCCTGGTCACCGTCTCGAGC

BMS2h-415 (SEQ ID NO: 588)
GAGGTGCAGCTGTTGGAGTCTGGGGGAGGTTTGGTGCAGCCTGGGGGGT
CCCTGCGTCTCTCCTGTGCAGCCTCCGGATTCACCTTTTTGGGTTATTA
TATGAGTTGGATCCGCCAGGCTCCAGGGAAGGGTCTAGAGTGGGTCTCA
ACGATTGGGCCGATTGGTGGTGGGACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
TCTCAGAATATTTATGGTCCTTTTGACTACTGGGGTCAGGGAACCCTGG
TCACCGTCTCGAGC

BMS2h-416 (SEQ ID NO: 589)
GAGGTGCAGCTGTTGGAGTCTGGGGGAGGCTTGGTACAGCCTGGGGGGT
CCCTGCGTCTCTCCTGTGCAGCCTCCGGATTCACCTTTGAGCAGTATGA
TATGGCTTGGGTCCGCCAGGCTCCAGGGAAGGGTCTAGAGTGGGTCTCA
GAGATTAGTCGTGATGGTGGGCGGACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGGAA
GAGTATCCTTATTTTGACTACTGGGGTCAGGGAACCCTGGTCACCGTCT
CGAGC

BMS2h-417 (SEQ ID NO: 590)
GAGGTGCAGCTGTTGGAGTCTGGGGGAGGCTTGGTACAGCCTGGGGGGT
CCCTGCGTCTCTCCTGTGCAGCCTCCGGATTCACCTTTCCGCAGTATAG
TATGGTGTGGGTCCGCCAGGCTCCAGGGAAGGGTCTTGAGTGGGTCTCA
ACTATTTCGCCTGGGTTCTTCGACATACTACGCAGACTCCGTGAAGG
GCCGGTTCACCATCTCCCGCGACAATTCCAAGAACACGCTGTATCTGCA
AATGAACAGCCTGCGTGCCGAGGATACCGCGGTATATTACTGTGCGAAA
ATGAGTAAGTTGTTGCTGTCGAGGGAGTTTGACTACTGGGGTCAGGGAA
CCCTGGTCACCGTCTCGAGC

BMS2h-418 (SEQ ID NO: 591)
GAGGTGCAGCTGTTGGAGTCTGGGGGAGGCTTGGTACAGCCTGGGGGGT
CCCTGCGTCTCTCCTGTGCAGCCTCCGGATTCACCTTTGCTATGTATTC
GATGGCTTGGGTCCGCCAGGCTCCAGGGAAGGGTCTAGAGTGGGTCTCA
GGTATTTCGCCTCGTGGTGTTGAGACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
ACTAATTGGAATGGTGTGGATCTGTTTGACTACTGGGGTCAGGGAACCC
TGGTCACCGTCTCGAGC

BMS2h-419 (SEQ ID NO: 592)
GAGGTGCAGCTGTTGGAGTCTGGGGGAGGCTTGGTACAGCCTGGGGGGT
CCCTGCGTCTCTCCTGTGCAGCCTCCGGATTCACCTTTACGCGTCATGG
TATGGCGTGGGTCCGCCAGGCTCCAGGGAAGGGTCTAGAGTGGGTCTCA
ACGATTACGCCTACTGGTAATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
GATGCTCATGATGAGGGGTATTTTGACTACTGGGGTCAGGGAACCCTGG
TCACCGTCTCGAGC

BMS2h-42 (SEQ ID NO: 593)
GAGGTGCAGCTGTTGGAGTCTGGGGGAGGCTTGGTACAGCCTGGGGGGT
CCCTGCGTCTCTCCTGTGCAGCCTCCGGATTCACCTTTGGTCCGATGA
GATGACTTGGGTCCGCCAGGCTCCAGGGAAGGGTCTAGAGTGGGTCTCA
TCGATTGTTGGTGATGGTCTGGATACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
CCGGATCGGGTTTTTGACTACTGGGGTCAGGGAACCCTGGTCACCGTCT
CGAGC

BMS2h-420 (SEQ ID NO: 594)
GAGGTGCAGCTGTTGGAGTCTGGGGGAGGCTTGGTACAGCCTGGGGGGT
CCCTGCGTCTCTCCTGTGCAGCCTCCGGATTCACCTTTGGTAGTACGCC
TATGATGTGGGTCCGCCAGGCTCCAGGGAAGGGTCTAGAGTGGGTCTCA
GAGATTAGGGGATACGGGTCTGGCTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAGT
GTTTCGTTTGACTACTGGGGTCAGGGAACCCTGGTCACCGTCTCGAGC

BMS2h-421 (SEQ ID NO: 595)
GAGGTGCAGCTGTTGGAGTCTGGGGGAGGCTTGGTACAGCCTGGGGGGT
CCCTGCGTCTCTCCTGTGCAGCCTCCGGATTCACCTTTCATCTGGGGGA
TATGCATTGGGTCCGCCAGGCTCCAGGGAAGGGTCTAGAGTGGGTCTCA
TCGATTAGTGGGACGGGTCATACTACATACTACGCAGACTCCGTGAAGG
GCCGGTTCACCATCTCCCGCGACAATTCCAAGAACACGCTGTATCTGCA
AATGAACAGCCTGCGTGCCGAGGATACCGCGGTATATTACTGTGCGAAA
CCTATGAATGATCAGGGGTTTGACTACTGGGGTCAGGGAACCCTGGTCA
CCGTCTCGAGC

BMS2h-422 (SEQ ID NO: 596)
GAGGTGCAGCTGTTGGAGTCTGGGGGAGGCTTGGTACAGCCTGGGGGGT
CCCTGCGTCTCTCCTGTGCAGCCTCCGGATTCACCTTTATGGATGAGGA
TATGTTGTGGGTCCGCCAGGCTCCAGGGAAGGGTCTAGAGTGGGTCTCA
AGGATTAATTCGCTGGGTACTCATACATACTACGCAGACTCCGTGAAGG
GCCGATTCACCATCTCCCGCGACAATTCCAAGAACACGCTGTATCTGCA
AATGAACAGCCTGCGTGCCGAGGATACCGCGGTATATTACTGTGCGAAA
TCGTTTATGATGTTTGACTACTGGGGTCAGGGAACCCTGGTCACCGTCT
CGAGC

BMS2h-423 (SEQ ID NO: 597)
GAGGTGCAGCTGTTGGAGTCTGGGGGAGGCTTGGTACAGCCTGGGGGGT
CCCTGCGTCTCTCCTGTGCAGCCTCCGGATTCACCTTTCGTAATTATCA
GATGCATTGGGTCCGCCAGGCTCCAGGGAAGGGTCTAGAGTGGGTCTCA
GGTATTGATGCGACTGGTCGGCGACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAGA
TCTACTAGGTCATTTGACTACTGGGGTCAGGGAACCCTGGTCACCGTCT
CGAGC

BMS2h-424 (SEQ ID NO: 598)
GAGGTGCAGCTGTTGGAGTCTGGGGGAGGCTTGGTACAGCCTGGGGGGT
CCCTGCGTCTCTCCTGTGCAGCCTCCGGATTCACCTTTACGAATGCGGA
TATGGTGTGGGTCCGCCAGGCTCCAGGGAAGGGTCTAGAGTGGGTCTCA
AGTATTAGTGGTAGTGGTGGTAGCACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
GGTTATTTGACTTCGCATTTTGACTACTGGGGTCAGGGAACCCTGGTCA
CCGTCTCGAGC

BMS2h-425 (SEQ ID NO: 599)
GAGGTGCAGCTGTTGGAGTCTGGGGGAGGCTTGGTACAGCCTGGGGGGT
CCCTGCGTCTCTCCTGTGCAGCCTCCGGATTCACCTTTAGGGATTATTC
TATGGTTTGGGTCCGCCAGGCTCCAGGGAAGGGTCTAGAGTGGGTCTCA
ACTATTACTCCGTCGGGTCTTACGACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
TGGTCTCAGGCGGTTACTCGGTCTTTTGACTACTGGGGTCAGGGAACCC
TGGTCACCGTCTCGAGC

BMS2h-426 (SEQ ID NO: 600)
GAGGTGCAGCTGTTGGAGTCTGGGGGAGACTTGGTACAGCCTGGGGGGT
CCCTGCGTCTCTCCTGTGCAGCCTCCGGATTCACCTTTTCTGATGAGGG
TATGATGTGGGTCCGCCAGGCTCCAGGGAAGGGTCTAGAGTGGGTCTCA
GAGATTAATCAGCAGGGTTCGGCGACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
ACGATTGGGATGTTTGACTACTGGGGTCAGGGAACCCTGGTCACCGTCT
CGAGC

BMS2h-427 (SEQ ID NO: 601)
GAGGTGCAGCTGTTGGAGTCTGGGGGAGGCTTGGTACAGCCTGGGGGGT
CCCTGCGTCTCTCCTGTGCAGCCTCCGGATTCACCTTTACTGATCAGCC
GATGGTGTGGGTCCGCCAGGCTCCAGGGAAGGGTCTAGAGTGGGTCTCA
TCGATTGGGGCGCGTGGTGGCCTACATACTACGCAGACTCCGTGAAGG
GCCGGTTCACCGTCTCCCGCGACAATTCCAAGAACACGCTGTATCTGCA
AATGAACAGCCTGCGTGCCGAGGACACCGCGGTATATTACTGTGCGAAA
TGGTTTGATATTATTGCTTGGGATCCTTTTAGTTTTGACTACTGGGGTC
AGGGAACCCTGGTCACCGTCTCGAGC

BMS2h-428 (SEQ ID NO: 602)
GAGGTGCAGCTGTTGGAGTCTGGGGGAGGCTTGGTACAGCCTGGGGGGT
CCCTGCGTCTCTCCTGTGCAGCCTCCGGATTCACCTTTAATCAGTATCC
TATGATGTGGGTTCGCCAGGCTCCAGGGAAGGGTCTAGAGTGGGTCTCA

TABLE 2-continued

Human Anti-CD40L VH Domain Encoding Nucleotide Sequences

AGTATTACTCCTTCTGGTTTTTTGACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGGAA
TGGAATCCTTTTATTACTACGTTTGACTACTGGGGTCAGGGAACCCTGG
TGACCGTCTCGAGC

BMS2h-429 (SEQ ID NO: 603)
GAGGTGCAGCTGTTGGAGTCTGGGGGAGGCTTGGTACAGCCTGGGGGGT
CCCTGCGTCTCTCCTGTGCAGCCTCCGGATTCACCTTTGGGCATCAGCA
GATGCGTGGGTCCGCCAGGCTCCAGGGAAGGGTCTAGAGTGGGTCTCA
ACTATTACTCCGAATGGTTATTATACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
TTTGATTATTCGCTTCGTTTTGACTACTGGGGTCAGGGAACCCTGGTCA
CCGTCTCGAGC

BMS2h-43 (SEQ ID NO: 604)
GAGGTGCAGCTGTTGGAGTCTGGGGGAGGCTTGGTACAGCCTGGGGGGT
CCCTGCGTCTCTCCTGTGCAGCCTCCGGATTCACCTTTGCTTCTTATGA
TATGGCGTGGGTCCGCCAGGCTCCAGGGAAGGGTCTAGAGTGGGTCTCA
TCGATTGGTAGTGATGGTGGGCCGACATACTACGCAGACTCCGTGAAGG
GCCGGTTCACCATCTCCCGCGACAATTCCAAGAACACGCTGTATCTGCA
AATGAACAGCCTGCGTGCCGAGGACTCCGCGGTATATTACTGTGCGAAA
CCTGATAGGGCTTTTGACTACTGGGGTCAGGGAACCCTGGTCACCGTCT
CGAGC

BMS2h-430 (SEQ ID NO: 605)
GAGGTGCAGCTGTTGGAGTCTGGGGGAGGCTTGGTACAGCCTGGGGGGT
CCCTGCGTCTCTCCTGTGCAGCCTCCGGATTCACCTTTTCTGCGGAGCA
GATGACTTGGGCCCGCCAGGCTCCAGGGAAGGGTCTAGAGTGGGTCTCA
ACTATTACTCCGCATGGTGATTCTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
TGGCGGACTTTGGTTGATTGGCCTACGAGTGAGTCGTTTGACTACTGGG
GTCAGGGAACCCTGGTCACCGTCTCGAGC

BMS2h-44 (SEQ ID NO: 606)
GAGGTGCAGCTGTTGGAGTCTGGGGGAGGCTTGGTACAGCCTGGGGGGT
CCCTGCGTCTCTCCTGTGCAGCCTCCGGATTCACCTTTGCTTTATGA
TATGGGGTGGGTCCGCCAGGCTCCAGGGAAGGGTCTAGAGTGGGTCTCA
TCTATTGAGCCTACTGGTATTACGACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
CCTCATTTTACTGAGCTTGGTTTTGACTACTGGGGTCAGGGAACCCTGG
TCACCGTCTCGAGC

BMS2h-449 (SEQ ID NO: 607)
GAGGTGCAGCTGTTGGAGTCTGGGGGAGGCTTGGTACAGCCTGGGGGGT
CCCTGCGTCTCTCCTGTGCAGCCTCCGGATTCACCTTTGAGGGGAGCA
GATGGCTTGGGTCCGCCAGGCTCCAGGGAAGGGTCTAGAGTGGGTCTCA
ACGATTACGCTGCCTGGTCCGTATACATTCTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
GGGAATGGGACGTTTTTTGACTACTGGGGTCAGGGAACCCTGGTCACCG
TCTCGAGC

BMS2h-45 (SEQ ID NO: 608)
GAGGTGCAGCTGTTGGAGTCTGGGGGAGGCTTGGTACAGCCTGGGGGGT
CCCTGCGTCTCTCCTGTGCAGCCTCCGGATTCACCTTTGGTAATTATGC
GATGGCGTGGGTCCGCCAGGCTCCAGGGAAGGGTCTAGAGTGGGTCTCA
AAGATTGGGGCGCAGGGTCTTCATACATACTACGCAGGCTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
CAGACACGATGGATTATGAGAGGTTTGACTACTGGGGTCAGGGAACCCT
GGTCACCGTCTCGAGC

BMS2h-450 (SEQ ID NO: 609)
GAGGTGCAGCTGTTGGAGTCTGGGGGAGGCTTGGTACAGCCTGGGGGGT
CCCTGCGTCTCTCCTGTGCAGCCTCCGGATTCACCTTTGATGAGGTTGA
TATGTCGTGGGTCCGCCAGGCTCCAGGGAAGGGTCTGGAGTGGGTCTCA
GCTATTGGTAATAATGGTCTTAAGACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
TCGGCTCTGTCGTATAGGCCTCCTGTTTTGACTACTGGGGTCAGGGAA
CCCTGGTCACCGTCTCG
AGC

BMS2h-451 (SEQ ID NO: 610)
GAGGTGCAGCTGTTGGAGTCTGGGGGAGGCTTGGTACAGCCTGGGGGGT
CCCTGCGTCTCTCCTGTGCAGCCTCCGGATTCACCTTTCAGGATGATAC
TATGTCGTGGGTCCGCCAGGCTCCAGGGAAGGGTCTAGAGTGGGTCTCA
ACGATTACGCTTAAGGGTCCGTCTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
TCGAGGGATGGGTTGTATTTTGACTACTGGGGTCAGGGAACCCTGGTCA
CCGTCTCGAGC

BMS2h-452 (SEQ ID NO: 611)
GAGGTGCAGCTGTTGGAGTCTGGGGGAGGCTTGGTACAGCCTGGGGGGT
CCCTGCGTCTCTCCTGTGCAGCCTCCGGATTCACCTTTGCTTCGTCTCC
GATGGCTTGGGTCCGCCAGGCTCCAGGGAAGGGTCTAGAGTGGGTCTCA
AGTATTGGTCGGGATGGTAGTACGACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
CCTTCGCCTTATCGGCGGTTTGACTACTGGGGTCAGGGAACCCTGGTCA
CCGTCTCGAGC

BMS2h-453 (SEQ ID NO: 612)
GAGGTGCAGCTGTTGGAGTCTGGGGGAGGCTTGGTACAGCCTGGGGGGT
CCCTGCGTCTCTCCTGTGCAGCCTCCGGATTCACCTTTACTGATTATTC
GATGGTTTGGGTCCGCCAGGCTCCAGGGAAGGGTCTAGAGTGGGTCTCA
ACTATTGTGAGTCATGGTGGTACTACATACTACGCAGACTCCGTGAAGG
GCCGATTCACCATCTCCCGCGACAATTCCAAGAACACGCTGTATCTGCA
AATGAACAGCCTGCGTGCCGAGGACACCGCGGTATATTACTGTGCGAAA
GGTAAGGGTTATAATGCGCAGTATTTTGACTACTGGGGTCAGGGAACCC
TGGTCACCGTCTCGAGC

BMS2h-454 (SEQ ID NO: 613)
GAGGTGCAGCTGTTGGAGTCTGGGGGAGGCTTGGTACAGCCTGGGGGGT
CCCTGCGTCTCTCCTGTGCAGCCTCCGGATTCACCTTTGGGCATCAGCA
GATGCGTGGGTCCGCCAGGCTCCAGGGAAGGGTCTAGAGTGGGTCTCA
ACTATTACTCCGAATGGTTATTATACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
TTTGATTATTCGCTTCGTTTTGACTACTGGGGTCAGGGAACCCTGGTCA
CCGTCTCGAGC

BMS2h-455 (SEQ ID NO: 614)
GAGGTGCAGCTGTTGGAGTCTGGGGGAGGCTTGGTACAGCCTGGGGGGT
CCCTGCGTCTCTCCTGTGCAGCCTCCGGATTCACCTTTAATGATTATGA
TATGATTTGGGTCCGCCAGGCTCCAGGGAAGGGTCTAGAGTGGGTCTCA
ACTATTAGTTCGCATGGTGATAGTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
GGTGATGTTTTTTTTGACTACTGGGGTCAGGGAACCCTGGTCACCGTCT
CGAGC

BMS2h-456 (SEQ ID NO: 615)
GAGGTGCAGCTGTTGGAGTCTGGGGGAGGCTTGGTACAGCCTGGGGGGT
CCCTGCGTCTCTCCTGTGCAGCCTCCGGATTCACCTTTGGGCATCAGCA
GATGGCGTGGGTCCGCCAGGCTCCAGGGAAGGGTCTAGAGTGGGTCTCA
ACTATTACTCCGAATGGTTATTATACATACTACGCAGACTCCGTGAAGG
GCCGGTTCACCATCTCCCGCGACAATTCCAAGAACACGCTGTATCTGCA
AATGAACAGCCTGCGTGCCGAGGATACCGCGGTATATTACTGTGCGGAA
TGGTCGGATTCTTTTGACTACAGGGGTCAGGGAACCCTGGTCACCGTCT
CGAGC

BMS2h-457 (SEQ ID NO: 616)
GAGGTGCAGCTGTTGGAGTCTGGGGGAGGCTTGGTACAGCCTGGGGGGT
CCCTGCGTCTCTCCTGTGCAGCCTCCGGATTCACCTTTGCTGATTATGA
GATGGCTTGGGTCCGCCAGGCTCCAGGGAAGGGTCTAGAGTGGGTCTCA
GGGATTCAGTCTAATGGTAATATTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
GCTAATTCTCAGGTTGAGTATTTTGACTACTGGGGTCAGGGAACCCTGG
TCACCGTCTCGAGC

BMS2h-458 (SEQ ID NO: 617)
GAGGTGCAGCTGTTGGAGTCTGGGGGAGGCTTGGTACAGCCTGGGGGGT
CCCTGCGTCTCTCCTGTGCAGCCTCCGGATTCACCTTTGGGGTGGAGCC
TATGCTTGGGTCCGCCAGGCTCCAGGGAAGGGTCTAGAGTGGGTCTCA
AATATTGGTCGTGATGGTTCGATGACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA

TABLE 2-continued

Human Anti-CD40L VH Domain Encoding Nucleotide Sequences

TTGGGGAAGCATGGTACTTTTGACTACTGGGGTCAGGGAACCCTGGTCA
CCGTCTCGAGC

BMS2h-459 (SEQ ID NO: 618)
GAGGTGCAGCTGTTGGAGTCTGGGGGAGGCTTGGTACAGCCTGGGGGGT
CCCTGCGTCTCTCCTGTGCAGCTCCGGATTCACCTTTCCGGAGTATCG
GATGATGTGGGTCCGCCAGGCTCCAGGGAAGGGTCTGGAGTGGGTCTCA
TGGATTGATGAGCGGGGTTCGCTTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
AGGCGGAAGGGTACTAAGCAGTTTGACTACTGGGGTCAGGGAACCCTGG
TCACCGTCTCGAGC

BMS2h-46 (SEQ ID NO: 619)
GAGGTGCAGCTGTTGGAGTCTGGGGGAGGCTTGGTACAGCCTGGGGGGT
CCCTGCGTCTCTCCTGTGCAGCCTCCGGATTCACCTTTGAGTTGTATGC
TATGGCGTGGGTCCGCCAGGCTCCAGGGAAGGGTCTAGAGTGGGTCTCA
GGTATTGGTGCTGTGGGTAGATACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
GAGGCTAATAATCTTTCTGATAATCTTGTGTTTGACTACTGGGGTCAGG
GAACCCTGGTCACCGTCTCGAGC

BMS2h-460 (SEQ ID NO: 620)
GAGGTGCAGCTGTTGGAGTCTGGGGGAGGCTTGGTACAGCCTGGGGGGT
CCCTGCGTCTCTCCTGTGCAGCTCCGGATTCACCTTTGGGCATCAGCA
GATGGCGTGGGTCCGCCAGGCTCCAGGGAAGGGTCTAGAGTGGGTCTCA
ACTATTACTCCGAATGGTTATTATACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
TGGTCGGTTGAGTGGTTTGACTACTGGGGTCAGGGAACCCTGGTCACCG
TCTCGAGC

BMS2h-461 (SEQ ID NO: 621)
GAGGTGCAGCTGTTGGAGTCTGGGGGAGGCTTGGTACAGCCTGGGGGGT
CCCTGCGTCTCTCCTGTGCAGCCTCCGGATTCACCTTTAATAGTTATAC
GATGAATTGGGTCCGCCAGGCTCCAGGGAAGGGTCTAGAGTGGGTCTCA
AGTATTAATCCTTGGGGTAGTCGGACATACTACGCAGACTCCGTGAAGG
GCCGGTTCACCATCTCCCGCGACAATTCCAAGAACACGCTGTATCTGCA
AATGAACAGCCTGCGTGCCGAGGATACCGCGGTATATTACTGTGCGAAA
GGTCTGGTGCTGTTTGACTACTGGGGTCAGGGAACCCTGGTCACCGTCT
CGAGC

BMS2h-462 0 (SEQ ID NO: 622)
GAGGTGCAGCTGTTGGAGTCTGGGGGAGGCTTGGTACAGCCTGGGGGGT
CCCTGCGTCTCTCCTGTGCAGCCTCCGGATTCACCTTTGATGGTGATAT
GATGTCTTGGGTCCGCCAGGCTCCAGGGAAGGGTCTAGAGTGGGTCTCA
TCGATTACTCAGCTTGGTAGTAGGACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
CAGAATTGGCGGACTCTTACTTTTGACTACTGGGGTCAGGGAACCCTGG
TCACCGTCTCGAGC

BMS2h-463 (SEQ ID NO: 623)
GAGGTGCAGCTGTTGGAGTCTGGGGGAGGCTTGGTACAGCCTGGGGGGT
CCCTGCGTCTCTCCTGCGCAGCTCCGGATTCACCTTTAATGCTTATGG
GATGATGTGGGTCCGCCAGGCTCCAGGGAAGGGTCTAGAGTGGGTCTCA
TCTATTCTTTCTGATGGTGTTATTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
AGTGCTCGGGGTGCGAATTTTTTTGACTACTGGGGTCAGGGAACCCTGG
TCACCGTCTCGAGC

BMS2h-464 (SEQ ID NO: 624)
GAGGTGCAGCTGTTGGAGTCTGGGGGAGGCTTGGTACAGCCTGGGGGGT
CCCTGCGTCTCTCCTGTGCAGCCTCCGGATTCACCTTTGGGCATTATAT
GATGGTGTGGGTCCGCCAGGCTCCAGGGAAGGGTCTGGAGTGGGTCTCA
TCTATTACGCCTCATGTAGTAGTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
TTTAATGCTATTTTAGTGAGGCGTTTGACTACTGGGGTCAGGGAACCC
TGGTCACCGTCTCGAGC

BMS2h-465 (SEQ ID NO: 625)
GAGGTGCAGCTGTTGGAGTCTGGGGGAGGCTTGGTACAGCCTGGGGGGT
CCCTGCGTCTCTCCTGTGCAGCCTCCGGATTCACCTTTAGGGATTATTC
TATGGCTTGGGTCCGCCAGGCTCCAGGGAAGGGTCTAGAGTGGGTCTCA
ACTATTACTCCGTCGGGTCTTACGACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGGAA
TGGTCTCAGGCGGTTACTCGGTCTTTTGACTACTGGGGTCAGGGAACCC
TGGTCACCGTCTCGAGC

BMS2h-466 (SEQ ID NO: 626)
GAGGTGCAGCTGTTGGAGTCTGGGGGAGGCTTGGTACAGCCTGGGGGGT
CCCTGCGTCTCTCCTGTGCAGCCTCCGGATTCACCTTTGATCTTTATGC
GATGGCTTGGGTCCGCCAGGCTCCAGGGAAGGGTCTAGAGTGGGTCTCA
ATGATTGGGAGGGATGGTCGTTTTACATACTACGCAGACTCCGTGAAGG
GCCGGTTCACCATCTCCCGCGACAATTCCAAGAACACGCTGTATCTGCA
AATGAACAGCCTGCGTGCCGAGGACACGCGGTATATTACTGTGCGAAA
TTGGCTGTTCGCTGAGGGGTCGTTTTGACTACTGGGGTCAGGGAACCC
TGGTCACCGTCTCGAGC

BMS2h-467 (SEQ ID NO: 627)
GAGGTGCAGCTGTTGGAGTCTGGGGGAGGCTTGGTACAGCCTGGGGGGT
CCCTGCGTCTCTCCTGTGCAGCCTCCGGATTCACCTTTAATAAGGCTAG
TATGGGTTGGGTCCGCCAGGCTCCAGGGAAGGGTCTAGAGTGGGTCTCA
ACTATTACGCCTCATGGTTCGTCTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
CAGCGGTGGGGTGTTGAGTTTGACTACTGGGGTCAGGGAACCCTGGTCA
CCGTCTCGAGC

BMS2h-468 (SEQ ID NO: 628)
GAGGTGCAGCTGTTGGAGTCTGGGGGAGGCTTGGTACAGCCTGGGGGGT
CCCTGCGTCTCTCCTGTGCAGCCTCCGGATTCACCTTTCAGGGGTATAG
TATGGGTTGGGTCCGCCAGGCTCCAGGGAAGGGTCTAGAGTGGGTCTCA
TCTATTGCTGGGCGTGGTGGTGTTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
GGTTTGTATATTTATCATAGTCTGTTTGACTACTGGGGTCAGGGAACCC
TGGTCACCGTCTCGAGC

BMS2h-469 (SEQ ID NO: 629)
GAGGTGCAGCTGTTGGAGTCTGGGGGAGGCTTGGTACAGCCTGGGGGCT
CCCTGCGTCTCTCCTGTGCAGCCTCCGGATTCACCTTTCCTGGTATGGA
GATGTCGTGGGTCCGCCAGGCTCCAGGGAAGGGTCTAGAGTGGGTCTCA
GCTATTACTGGGACTGGTAGTACGACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
GGTTATCATCCGTTTGACTACTGGGGTCAGGGAACCCTGGTCACCGTCT
CGAGC

BMS2h-470 (SEQ ID NO: 630)
GAGGTGCAGCTGTTGGAGTCTGGGGGAGGCTTGGTACAGCCTGGGGGGT
CCCTGCGTCTCTCCTGTGCAGCCTCCGGATTCACCTTTCCGATGGTGGC
TATGTCTTGGGTCCGCCAGGCTCCAGGGAAGGGTCTAGAGTGGGTCTCA
TCTATTGCTCGGGATGGTAATGTTACATACTACGCAGACTCCGTGAAGG
GCCGGTTCACCATCTCCCGCGACAATTCCAAGAACACGCTGTATCTGCA
AATGAACAGCCTGCGTGCCGAGGACGCCGCGGTATATTACTGTGCGAAA
GTTTCGCGACTGGTTTTGACTACTGGGGTCAGGGAACCCTGGTCACCG
TCTCGAGC

BMS2h-471 (SEQ ID NO: 631)
GAGGTGCAGCTGTTGGAGTCTGGGGGAGGCTTGGTACAGCCTGGGGGGT
CCCTGCGTCTCTCCTGTGCAGCCTCCGGATTCACCTTTGGGCATCAGGA
TATGTCGTGGGTCCGCCAGGCTCCAGGGAAGGGTCTAGAGTGGGTCTCA
GGGATTACGGATGATGGTGAGAGTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
GGTGATTATGATTTTGACTACTGGGGTCAGGGAACCCTGGTCACCGTCT
CGAGC

BMS2h-472 (SEQ ID NO: 632)
GAGGTGCAGCTGTTGGAGTCTGGGGGAGGCTTGGTACAGCCTGGGGGGT
CCCTGCGTCTCTCCTGTGCAGCCTCCGGATTCACCTTTGGGAGTATAA
TATGTGGTGGGTCCGCCAGGCTCCAGGGAAGGGTCTAGAGTGGGTCTCA
CAGATTACGAGGGATGGTTCTAGGACATACTACGCAGACTCCGTGAGGG
GCCGGTTCACCATCTCCCGCGACAATTCCAAGAACACGCTGTATCTGCA
AATGAACAGCCTGCGTGCCGAGGACTCCGCGGTATATTACTGTGCGAAA
CTGTCGAATATTGGGTTTGACTACTGGGGTCAGGGAACCCTGGTCACCG
TCTCGAGC

TABLE 2-continued

Human Anti-CD40L VH Domain Encoding Nucleotide Sequences

BMS2h-473 (SEQ ID NO: 633)
GAGGTGCAGCTGTTGGAGTCTGGGGGAGGCTTGGTACAGCCTGGGGGGT
CCCTGCGTCTCTCCTGTGCAGCCTCCGGATTCACCTTTAGTGATTATTC
TATGATTTGGGCCCGCCAGGCTCCAGGGAAGGGTCTAGAGTGGGTCTCA
TCGATTACGCCGTATGGTTCTTATACATACTACGCAGACTCCGTGAAGG
GCCGGTTCACCATCTCCCGCGACAATTCCAAGAACACGCTGTATCTGCA
AATGAACAGCCTGCGTGCCGAGGATACCGCGGTATATTACTGTGCGAAA
ACTGATTATTTGTTTGACTACTGGGGTCAGGGAACCCTGGTCACCGTCT
CGAGC

BMS2h-474 (SEQ ID NO: 634)
GAGGTGCAGCTGTTGGAGTCTGGGGGAGGCTTGGTACAGCCTGGGGGGT
CCCTGCGTCTCTCCTGTGCAGCCTCCGGATTCACCTTTGATACGTATAG
TATGATGTGGGTCCGCCAGGCTCCAGGGAAGGGTCTTGAGTGGGTCTCA
ACTATTACTCCTTATGGTAGTTCGACATACTACGCAGACTCCGTGAAGG
GCCGGTTCACCATCTCCCGCGACAATTCCAAGAACACGCTGTATCTGCA
AATGAACAGCCTGCGTGCCGAGGATACCGCGGTATATTACTGTGCGAAA
TGGGGTCTGGTGTTTGACTACTGGGGTCAGGGAACCCTGGTCACCGTCT
CGAGC

BMS2h-475 (SEQ ID NO: 635)
GAGGTGCAGCTGTTGGAGTCTGGGGGAGGCTTGGTACAGCCTGGGGGGT
CCCTGCGACTCTCCTGTGCAGCCTCCGGATTCACCTTTACTACGGGTCC
TATGATGTGGGTCCGCCAGGCTCCAGGGAAGGGTCTAGAGTGGGTCTCA
GCGATTGGTATTGGGGTGATACGACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
TTGACTCCGTCTAATCAGTTTGACTACTGGGGTCAGGGAACCCTGGTCA
CCGTCTCGAGC

BMS2h-476 (SEQ ID NO: 636)
GAGGTGCAGCTGTTGGAGTCTGGGGGAGGCTTGGTACAGCCTGGGGGGT
CCCTGCGTCTCTCCTGTGCAGCCTCCGGATTCACCTTTAAGCAGTATCA
GATGATGTGGGTTCCGCCAGGCTCCAGGGAAGGGTCTAGAGTGGGTCTCA
AGTATTACTCCTTGGTTTTTTGACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAA
TGGAATCCTTTTATTAGTACGTTTGACTACTGGGGTCAGGGAACCCTGG
TCACCGTCTCGAGC

BMS2h-477 (SEQ ID NO: 637)
GAGGTGCAGCTGTTGGAGTCTGGGGGAGGCTTGGTACAGCCTGGGGGGT
CCCTGCGTCTCTCCTGTGCAGCCTCCGGATTCACCTTTCCTAATTATGA
TATGGTTTGGGTCCGCCAGGCTCCAGGGAAGGGTCTAGAGTGGGTCTCA
TCGATTTCTGCTTTGGGTAATGTTACATACTACGCAGACTCCGTGAAGG
GCCGGTTCACCATCTCCCGCGACAATTCCAAGAACACGCTGTATCTGCA
AACGAACAGCCTGCGTGCCGAGGACACTGCGTATATTACTGTGCGAAA
TGGCGTAGTGCTATTACTGGTAATTTTGACTACTGGGGTCAGGGAACCC
TGGTCACCGTCTCGAGC

BMS2h-478 (SEQ ID NO: 638)
GAGGTGCAGCTGTTGGAGTCTGGGGGAGGCTTGGTACAGCCTGGGGGGT
CCCTGCGTCTCTCCTGTGCAGCCTCCGGATTCACCTTTAAGGAGTATCA
GATGTCTTGGGTCCGCCAGGCTCCAGGGAAGGGTCTAGAGTGGGTCTCA
ACTATTTCGCCGTCGGGTATGAATACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
TGGCGGTCGGTTGTTCGTCCTTGGCCGGTGTGTTTGACTACTGGGGTC
AGGGAACCCTGGTCACCGTCTCGAGC

BMS2h-479 (SEQ ID NO: 639)
GAGGTGCAGCTGTTGGAGTCTGGGGGAGGCTTGGTACAGCCTGGGGGGT
CCCTGCGTCTCTCCTGTGCAGCCTCCGGATTCACCTTTGATGATGAGAG
TATGGCGTGGGTCCGCCAGGCTCCAGGGAAGGGTCTAGAGTGGGTCTCA
TCGATTACTCCTCATGGTACTTTTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
CTTCATCTTAAGTTGTATGAGTCACATTTTGACTACTGGGGTCAGGGAA
CCCTGGTCACCGTCTCGAGC

BMS2h-480 (SEQ ID NO: 640)
GAGGTGCAGCTGTTGGAGTCTGGGGGAGGCTTGGTACAGCCTGGGGGGT
CCCTGCGTCTCTCCTGTGCAGCCTCCGGATTCACCTTTGAGGGTGGTGA
ATGGGTTGGGTCCGCCAGGCTCCAGGGAAGGGTCTAGAGTGGGTCTCA
ATGATTCCGATGGATGGTAGTGCGACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
GCGGGGAGTACGTTTGACTACTGGGGTCAGGGAACCCTGGTCACCGTCT
CGAGC

BMS2h-481 (SEQ ID NO: 641)
GAGGTGCAGCTGTTGGAGTCTGGGGGAGGCTTGGTACAGCCTGGGGGGT
CCCTGCGTCTCTCCTGTGCAGCCTCCGGATTCACCTTTGATTTATGCC
GATGGCGTGGGTCCGCCAGGCTCCAGGGAAGGGTCTAGAGTGGGTCTCA
TCTATTGGGAGGGATGGTGCTTATACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
CTTGCTTCGCCGGCGCAGTTTGACTACTGGGGTCAGGGAACCCTGGTCA
CCGTCTCGAGC

BMS2h-482 (SEQ ID NO: 642)
GAGGTGCAGCTGTTGGAGTCTGGGGGAGGCTTGGTACAGCCTGGGGGGT
CCCTGCGTCTCTCCTGTGCAGCCTCCGGATTCACCTTTGGTGATGAGCC
TATGCGTGGGTCCGCCAGGCTCCAGGGAAGGGTCTAGAGTGGGTCTCA
TCTATTGGGGTACGGGTACGACAGATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
GGTAATCAGGGTGATTTTATTAATCGGTTTCACTACTGGGGTCAGGGAA
CCCTGGTCACCGTCTCGAGC

BMS2h-483 (SEQ ID NO: 643)
GAGGTGCAGCTGTTGGAGTCTGGGGGAGGCTTGGTACAGCCTGGGGGGT
CCCTGCGTCTCTCCTGTGCAGCCTCCGGATTCACCTTTCATGCGTATAA
TATGGCGTGGGTCCGCCAGGCTCCAGGGAAGGGTCTAGAGTGGGTCTCA
ACGATTTCTCCGCGGGTTCTTATACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
TGGCCGCCGCCTTCGTCTCATTTTGACTACTGGGGTCAGGGAACCCTGG
TCACCGTCTCGAGC

BMS2h-5 (SEQ ID NO: 644)
GAGGTGCAGCTGTTGGAGTCTGGGGGAGGCTTGGTACAGCCTGGGGGGT
CCCTGCGTCTCTCCTGTGCAGCCTCCGGATTCACCTTTGATGGGATGA
GATGGCGTGGGTCCGCCAGGCTCCAGGGAAGGGTCTAGAGTGGGTCTCA
TCTATTACGAGTGATGGTACGACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
CCGGGGCTGCGTTTTGACTACTGGGGTCAGGGAACCCTGGTCACCGTCT
CGAGC

BMS2h-505 (SEQ ID NO: 645)
GAGGTGCAGCTGTTGGAGTCTGGGGGAGGCTTGGTACAGCCTGGGGGGT
CCCTGCGTCTCTCCTGTGCAGCCTCCGGATTCACCTTTGAGGGTTATAT
GATGTATTGGGTCCACCAGGCTCCAGGGAAGGGTCTAGAGTGGGTCTCA
TCTATTTCTCCTCAGGGTCATTTTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGGAA
CTTCGTGAGCTTCCTCGTCTGTTTGACTACTGGGGTCAGGGAACCCTGG
TCACCGTCTCGAGC

BMS2h-506 (SEQ ID NO: 646)
GAGGTGCAGCTGTTGGAGTCTGGGGGAGGCTTGGTACAGCCTGGGGGGT
CCCTGCGTCTCTCCTGTGCAGCCTCCGGATTCACCTTTAGTAGTTATGC
TATGGGTTGGGTCCGCCAGGCTCCAGGGAAGGGTCTAGAGTGGGTCTCA
TCGATTGATGCGAGTGGTGGTCCTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
GCGAATGGGAAGAAGTTTCCTTTTACTAAGTATTTTGACTACTGGGGTC
AGGGAACCCTGGTCACCGTCTCGAGC

BMS2h-507 (SEQ ID NO: 647)
GAGGTGCAGCTGTTGGAGTCTGGGGGAGGCTTGGTACAGCCTGGGGGGT
CCCTGCGTCTCTCCTGTGCAGCCTCCGGATTCACCTTTCCTAGTGTGCA
TATGGCGTGGGTCCGCCAGGCTCCAGGGAAGGGTCTAGAGTGGGTCTCA
GGGATTAATCTGACGGGTGTTGACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
AGTGCTACTACTAGGCAGGCGCATCCGTTGTATTTTGACTACTGGGGTC
AGGGAACCCTGGTCACCGTCTCGAGC

BMS2h-515 (SEQ ID NO: 648)
GAGGTGCAGCTGTTGGAGTCTGGGGGAGGCTTGGTACAGCCTGGGGGGT
CCCTGCGTCTCTCCTGTGCAGCCTCCGGATTCACCTTTAAGGAGGGTGA

TABLE 2-continued

Human Anti-CD40L VH Domain Encoding Nucleotide Sequences

GATGTATTGGGTCCGCCAGGCTCCAGGGAAGGGTCTAGAGTGGGTCTCA
ACGATTTCGACTAATGGTCTTACTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
TCTACTCGTGATCTGGGTTTTGCCTACTGGGGTCAGGGAACCCTGGTCA
CCGTCTCGAGC

BMS2h-516 (SEQ ID NO: 649)
GAGGTGCAGCTGTTGGAGTCTGGGGGAGGCTTGGTACAGCCTGGGGGGT
CCCTGCGTCTCTCCTGTGCAGCCTCCGGATTCACCTTTGAGGAGTATGA
GATGGCTTGGGCCCGCCAGGCTCCAGGGAAGGGTCTAGAGTGGGTCTCA
TTTATTTCTCCTCGTGGTCATTTTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
CCGGCTAAGACTTTTGACTACTGGGGTCAGGGAACCCTGGTCACCGTCT
CGAGC

BMS2h-517 (SEQ ID NO: 650)
GAGGTGCAGCTGTTGGAGTCTGGGGGAGGCTTGGTACAGCCTGGGGGGT
CCCTGCGTCTCTCCTGTGCAGCCTCCGGATTCACCTTTGATACGTATGA
GATGCTTTGGGTCCGCCAGGCTCCAGGGAAGGGTCTAGAGTGGGTCTCA
CGTATTTCTGTTGATGGTAGTATTACATACTACGCAGACTCCGTGAAGG
GCCGGTTCACCATCTCCCGCGACAATTCCAAGAACACGCTGTATCTGCA
AATGAACAGCCTGCGTGCCGAGGATACCGCGGTATATTACTGTGCGAAA
ACGCGGATGCGTTTTGACTACTGGGGTCAGGGAACCCTGGTCACCGTCT
CGAGC

BMS2h-518 (SEQ ID NO: 651)
GAGGTGCAGCTGTTGGAGTCTGGGGGAGGCTTGGTACAGCCTGGGGGGT
CCCTGCGTCTCTCCTGTGCAGCCTCCGGATTCACCTTTAGTTCGTATGC
TATGTCGTGGGTCCGCCAGGCTCCAGGGAAGGGTCTAGAGTGGGTCTCA
AATATTTCTCGTGATGGTTCGAAGACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
GCGCAGTCTGGGGGGCTTCGGTCGGGTTTGACTACGTTTGACTACTGGG
GTCAGGGAACCCTGGTCACCGTCTCGAGC

BMS2h-519 (SEQ ID NO: 652)
GAGGTGCAGCTGTTGGAGTCTGGGGGAGGCTTGGTACAGCCTGGGGGGT
CCCTGCGTCTCTCCTGTGCAGACTCCGGATTCACCTTTAGCAGCTATGC
CATGAGCTGGGTCCGCCAGGCTCCAGGGAAGGGTCTAGAGTGGGTCTCA
TCTATTGGGAGGGATGGTGCTTATACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
GCGGGGCCGAAGGGTATTGCGTTTGACTACTGGGGTCAGGGAACCCTGG
TCACCGTCTCGAGC

BMS2h-520 (SEQ ID NO: 653)
GAGGTGCAGCTGTTGGAGTCTGGGGGAGGCTTGGTACAGCCTGGGGGGT
CCCTGCGTCTCTCCTGTGCAGCCTCCGGATTCACCTTTAGTCCGCATGC
TATGCTTGGGTCCGCCAGGCTCCAGGGAAGGGTCTGGAGTGGGTCTCA
GGTATTGATGGGGGGGTTCGATGACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
TCGGATCCTCCGTTTGACTACTGGGGTCAGGGAACCCTGGTCACCGTCT
CGAGC

BMS2h-521 (SEQ ID NO: 654)
GAGGTGCAGCTGTTGGAGTCTGGGGGAGGCTTGGTACAGCCTGGGGGGT
CCCTGCGTCTCTCCTGTGCAGCCTCCGGATTCACCTTTCATGCGGGGGA
GATGCATTGGGTCCGCCAGGCTCCAGGGAAGGGTCTAGAGTGGGTCTCA
TCGATTACGCTGCCTGGTGATATGACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
CCGAATACTGGGTATACTTTTGACTACTGGGGTCAGGGAACCCTGGTCA
CCGTCTCGAGC

BMS2h-522 (SEQ ID NO: 655)
GAGGTGCAGCTGTTGGAGTCTGGGGGAGGCTTGGTACAGCCTGGGGGGT
CCCTGCGTCTCTCCTGTGCAGCCTCCGGATTCACCTTTGGGAATTATGG
TATGTCGTGGGTCCGCCAGGCTCCAGGGAAGGGTCTAGAGTGGGTCTCA
AGTATTTCGTGGGATGGTTCTTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGCAA
AATACGCGGCTTTTTGACTACTGGGGTCAGGGAACCCTGGTCACCGTCT
CGAGC

BMS2h-523 (SEQ ID NO: 656)
GAGGTGCAGCTGTTGGAGTCTGGGGGAGGCTTGGTACAGCCTGGGGGGT
CCCTGCGTCTCTCCTGTGCAGCCTCCGGATTCACCTTTCATGATGCGGA
TATGCTGTGGGTCCGCCAGGCTCCAGGGAAGGGTCTAGAGTGGGTCTCA
GGTATTTTGTCTCCGGGTGAGGATACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
TTTGGTCTGCCGTTTGACTACTGGGGTCAGGGAACCCTGGTCACCGTCT
CGAGC

BMS2h-524 (SEQ ID NO: 657)
GAGGTGCAGCTGTTGGAGTCTGGGGGAGGCTTGGTACAGCCTGGGGGGT
CCCTGCGTCTCTCCTGTGCAGCCTCCGGATTCACCTTTCGTACTGATCA
GATGAATTGGGTCCGCCAGGCTCCAGGGAAGGGTCTAGAGTGGGTCTCA
AGTATTTCTCCTAGTGGTGCGTATACATACTACGCAGACTCCGTGAAGG
GCCGGTTCACCATCTCCCGCGACAATTCCAAGAACACGCTGTATCTGCA
AATGAACAGCCTGCGTGCCGAGGATACCGCGGTATATTACTGTGCGAAA
GGTCTTGGTGCTTTTGACTACTGGGGTCAGGGAACCCTGGTCACCGTCT
CGAGC

BMS2h-525 (SEQ ID NO: 658)
GAGGTGCAGCTGTTGGAGTCTGGGGGAGGCTTGGTACAGCCTGGGGGGT
CCCTGCGTCTCTCCTGTGCAGCCTCCGGATTCATCTTTGAGCAGTATCA
GATGGTTTGGGTCCGCCAGGCTCCAGGGAAGGGTCTAGAGTGGGTCTCA
TGGATTTCGCCTGATGGTACGCATACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
TTTAGTTTGCGTAAGATGGAGAAGTTTGACTACTGGGGTCAGGGAACCC
TGGTCACCGTCTCGAGC

BMS2h-526 (SEQ ID NO: 659)
GAGGTGCAGCTGTTGGAATCTGGGGGAGGCTTGGTACAGCCTGGGGGGT
CCCTGCGTCTCTCCTGTGCAGCCTCCGGATTCACCTTTCAGGATGAGCA
GATGCGTGGGTCCGCCAGGCTCCAGGGAAGGGTCTAGAGTGGGTCTCA
AGTATTGCGTCTGATGGTATGCTACATACTACGCAGACTCCGTGAAGG
GCCGGTTCACCATCTCCCGCGACAATTCCAAGAACACGCTGTATCTGCA
AATGAATAGCCTGCGTGCCGAGGACACCGCGGTATATTACTGTGCGCAA
CCTGGGAAGAATTTTGACCACTGGGGTCAGGGAACCCTGGTCACCGTCT
CGAGC

BMS2h-527 (SEQ ID NO: 660)
GAGGTGCAGCTGTTGGAGTCTGGGGGAGGCTTGGTACAGCCTGGGGGGT
CCCTGCGTCTCTCCTGTGCAGCCTCCGGATTCACCTTTAGTGATTATGC
GATGAGTTGGGTCCGCCAGGCTCCAGGGAAGGGTCTAGAGTGGGTCTCA
TCGATTACTACTGGGGGTGAGCGGACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
CGTTGGAATCTGTATACGGAGTCTTTTGACTACTGGGGTCAGGGAACCC
TGGTCACCGTCTCGAGC

BMS2h-528 (SEQ ID NO: 661)
GAGGTGCAGCTGTTGGAGTCTGGGGGAGGCTTGGTACAGCCTGGGGGGT
CCCTGCGTCTCTCCTGTGCAGCCTCCGGATTCACCTTTGGTGGTCAGCC
GATGGATTGGGTCCGCCAGGCTCCAGGGAAGGGTCTAGAGTGGGTCTCA
TCTATTCCTGATGGTATTCATACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
AATTTGGGTCAGGGTTTTGACTACTGGGGTCAGGGAACCCTGGTCACCG
TCTCGAGC

BMS2h-529 (SEQ ID NO: 662)
GAGGTGCAGCTGTTGGAGTCTGGGGGAGGCTTGGTACAGCCTGGGGGGT
CCCTGCGTCTCTCCTGTGCAGCCTCCGGATTCACCTTTGAGCGGTATCA
GATGACGTGGGTCCGCCAGGCTCCAGGGAAGGGTCTAGAGTGGGTCTCA
AGTATTTCTCCTAGTGGTACGTTTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
TGGAAGGCGCTTTTTGACTACTGGGGTCAGGGAACCCTGGTCACCGTCT
CGAGC

BMS2h-530 (SEQ ID NO: 663)
GAGGTGCAGCTGTTGGAGTCTGGGGGAGGCTTGGTACAGCCTGGGGGGT
CCCTGCGTCTCTCCTGTGCAGCCTCCGGATTCACCTTTCCTCATTCGAC
TATGTATTGGGTCCGCCAGGCTCCAGGGAAGGGTCTAGAGTGGGTCTCA
CTTATTTTGCCGTCGGGTAGTCGTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA

TABLE 2-continued

Human Anti-CD40L VH Domain Encoding Nucleotide Sequences

TTTTCTGATGAGCGTTTTGACTACTGGGGTCAGGGAACCCTGGTCACCG
TCTCGAGC

BMS2h-531 (SEQ ID NO: 664)
GAGGTGCAGCTGTCGGAGTCTGGGGGAGGCTTGGTACAGCCTGGGGGGT
CCCTGCGTCTCTCCTGTGCAGCCTCCGGATTCACCTTTGGTGATGGGAA
TATGGATTGGGTCCGCCAGGCTCCAGGGAAGGGTCTAGAGTGGGTCTCA
GGTATTTCTAGTGATGGTGTGACGACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
GATAGGGGTCAGGGGTTTGACTACTGGGGTCAGGGAACCCTGGTCACCG
TCTCGAGC

BMS2h-532 (SEQ ID NO: 665)
GAGGTGCAGCTGTTGGAGTCTGGGGGAGGCTTGGTACAGCCTGGGGGGT
CCCTGCGTCTCTCCTGTGCAGCTTCCGGATTCACCTTTGATGATTATAT
GATGTGGTGGGTCCGCCAGGCTCCAGGGAAGGGTCTAGAGTGGGTCTCA
TCTATTAGTCGCATGGTGTTTATACATACTACGCAGACTCCGTGAAGG
GCCGGTTCACCATCTCCCGCGACAATTCCAAGAACACGCTGTATCTGCA
AATGAACAGCCTGCGTGCCGAGGATACCGCGGTATATTACTGTGCGAAA
TGGTTGCATACGTTTGACTACTGGGGTCAGGGAACCCTGGTCACCGTCT
CGAGC

BMS2h-533 (SEQ ID NO: 666)
GAGGTGCAGCTGTTGGAGTCTGGGGGAGGCTTGGTACAGCCTGGGGGGT
CCCTGCGTCTCTCCTGTGCAGCCTCCGGATTCACCTTTTCGAATTATAC
GATGGCGTGGGGCCGCCAGGCTCCAGGGAAGGGTCTAGAGTGGGTCTCA
TTTATTGCTGGTCCGGGTAATTATACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
CCGGGGAGTACTGCGACGTATAATAATGGTCAGTTTGACTACTGGGGTC
AGGGAACCCTGGTCACCGTCTCGAGC

BMS2h-534 (SEQ ID NO: 667)
GAGGTGCAGCTGTTGGAGTCTGGGGGAGGCTTGGTACAGCCTGGGGGGT
CCCTGCGTCTCTCCTGTGCAGCCTCCGGATTCACCTTTACGGAGTATAG
TATGGTGTGGGTCCGCCAGGCTCCAGGGAAGGGTCTGGAGTGGGTCTCA
TCTATTAGTGGGAGTGGTCGTGTTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
TGGCTTAAGCTGGTTAGGGCTCCTAATCCGTTTGACTACTGGGGTCAGG
GAACCCTGGTCACCGTCTCGAGC

BMS2h-535 (SEQ ID NO: 668)
GAGGTGCAGCTGTTGGAGTCTGGGGGAGGCTTGGTACAGCCTGGGGGGT
CCCTGCGTCTCTCCTGTGCAGCCTCCGGATTCACCTTTAGTAATTATCA
GATGGCGTGGGTCCGCCAGGCTCCAGGGAAGGGTCTAGAGTGGGTCTCA
GGTATTTCTAAGACTGGTCATTCTACATACTACGCAGACTCCGTGAAGG
GCCGGTTCACCATCTCCCGCGACAATTCCAGGAACACGCTGTATCTGCA
AATGAACAGCCTGCGTGCCGAGGACACCGCGGTATATTACTGTGCGAAA
GCTTCGCATTCGTTGGGGCCTCTTTTTGACTACTGGGGTCAGGGAACCC
TGGTCACCGTCTCGAGC

BMS2h-54 (SEQ ID NO: 669)
GAGGTGCAGCTGTTGGAGTCTGGGGGAGGCTTGGTACAGCCTGGGGGGT
CCCTGCGTCTCTCCTGTGCAGCCTCCGGATTCACCTTTACGGCGTATAG
GATGGCTTGGGTCCGCCAGGCTCCAGGGAAGGGTCTAGAGTGGGTCTCA
TGGATTTCGCCTTCTGGTTCGGGACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
ACTTTGACGGATTCGCCGTGGGGCATTATGAGTTTGACTACTGGGGTC
AGGGAACCCTGGTCACCGTCTCGAGC

BMS2h-55 (SEQ ID NO: 670)
GAGGTGCAGCTGTTGGAGTCTGGGGGAGGCTTGGTACAGCCTGGGGGGT
CCCTGCGTCTCTCCTGTGCAGCCTCCGGATTCACCTTTGCGCGGTATGA
GATGGGGTGGGTCCGCCAGGCTCCAGGGAAGGGTCTAGAGTGGGTCTCA
CGGATTACTGCTCAGGGTCTTGGACATACTACGCAGACTCCGTGAAGG
GCCGGTTCACCATCTCCCGCGACAACTCCAAGAACACGCTGTATCTGCA
AATGAACAGCCTGCGTGCCGAGGATACCGCGGTATATTACTGTGCGAAA
TATCTTACTGATTTAGTAGTGGGCATCAGGAGTTTGACTACTGGGGTC
AGGGAACCCTGGTCACCGTCTCGAGC

BMS2h-553 (SEQ ID NO: 671)
GAGGTGCAGCTGTTGGAGTCTGGGGGAGGCTTGGTACAGCCTGGGGGGT
CCCTGCGTCTCTCCTGTGCAGCCTCCGGATTCACCTTTGATGATTATGG
TATGTCGTGGGTCCGCCAGGTTCCAGGGAAGGGTCTAGAGTGGGTCTCA

TABLE 2-continued

Human Anti-CD40L VH Domain Encoding Nucleotide Sequences

GGTATTAGTCATAATGGTATGTTGACATACTACGCAGACTCCGTGAAGG
GCCGGTTCACCATCTCCCGCGACAATTCCAAGAACACGCTGTATCTGCA
AATGAACAGCCTGCGTGCCGAGGATACCGCGGTATATTACTGTGCGAAA
TATTGGCCGTCTACTAGTTGGGAGACTGATTTTGACTACTGGGGTCAGG
GAACCCTGGTCACCGTCTCGAGC

BMS2h-554 (SEQ ID NO: 672)
GAGGTGCAGCTGTTGGAGTCTGGGGGAGGCTCGGTACAGCCTGGGGGGT
CCCTGCGTCTCTCCTGTGCAGCCTCCGGATTCACCTTTGGGAATGAGCC
TATGGCTTGGGTCCGCCAGGCTCCAGGGAAGGGTCTAGAGTGGGTCTCA
AGTATTGAGATGCAGGGTAAGAATACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
GATAGGGGTCAGGGGTTTGACTACTGGGGTCAGGGAACCCTGGTCACCG
TCTCGAGC

BMS2h-555 1 (SEQ ID NO: 673)
GAGGTGCAGCTGTTGGAGTCTGGGGGAGGCTTGGTACAGCCTGGGGGGT
CCCTGCGTCTCTCCTGTGCAGCCTCCGGATTCACCTTTGGGGAGGAGGA
GATGAGTTGGGTCCGCCAGGCTCCAGGGAAGGGTCTAGAGTGGGTCTCA
TGTATTGATAATCTGGGTAGTCCTACATACTACGCAGACTCCGTGAAGG
GCCGGTTCACCATCTCCCGCGACAATTCCAAGAACACGCTGTATCTGCA
AATGAACAGCCTGCGTGCCGAGGACGCCGCGGTATATTACTGTGCGAAA
ACGATTTCTCATCAGTATGATAGGTTTGACTACTGGGGTCAGGGAACCC
TGGTCACCGTCTCGAGC

BMS2h-556 (SEQ ID NO: 674)
GAGGTGCAGCTGTTGGAGTCTGGGGGAGGCTTGGTACAGCCTGGGGGGT
CCCTGCGTCTCTCCTGTGCAGCCTCCGGATTCACCTTTGGGGAGGAGGA
GATGAGTTGGGTCCGCCAGGCTCCAGGGAAGGGTCTAGAGTGGGTCTCA
TCGATTGATGAGGGGGTCGGTGGACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
TGGACGCCGCATAAGCAGTTGTCGTTTGACTACTGGGGTCAGGGAACCC
TGGTCACCGTCTCGAGC

BMS2h-557 (SEQ ID NO: 675)
GAGGTGCAGCTGTTGGAGTCTGGGGGAGGCTTGGTACAGCCTGGGGGGT
CCCTGCCTCTCTCCTGTGCAGCCTCCGGATTCAGCTTTGCTGATGAGTA
TATGGTTTGGGTCCGCCAGGCTCCAGGGAAGGGTCTAGAGTGGGTCTCA
GAGATTGATCCGTTGGGTACTGGGACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
TATGGGACGGCTTTTGACTACTGGGGTCAGGGAACCCTGGTCACCGTCT
CGAGC

BMS2h-558 (SEQ ID NO: 676)
GAGGTGCAGCTGTTGGAGTCTGGGGGAGGCTTGGTACAGCCTGGGGGGT
CCCTGCGCCTCTCCTGTGCAGCCTCCGGATTCACCTTTTCTACGCATGA
TATGATGTGGGTCCGCCAGGCTCCAGGGAAGGGTCTAGAGTGGGTCTCA
TCGATTTCTGATGATGGTATTAGTACATACTACGCAGACTCCGTGAAGG
GCCGGTTCACCATTTCCCGCGACAATTCCAAGAACACGCTGTATCTGCA
AATGAACAGCCTGCGTGCCGAGGATACCGCGGTATATTACTGTGCGAAA
CCTGATATGTCTCTTATTGAGTTTGACTACTGGGGTCAGGGAACCCTGG
TCACCGTCTCGAGC

BMS2h-559 (SEQ ID NO: 677)
GAGGTGCAGCTGTTGGAGTCTGGGGGAGGCTTGGTACAGCCTGGGGGGT
CCCTGCGTCTCTCCTGTGCAGCCTCCGGATTCACCTTTGATGGTACTCC
GATGGTTTGGGTCCGCCAGGCTCCAGGGAAGGGTCTAGAGTGGGTCTCA
GGGATTAGTGGTGATGGTAGGAATACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
CCTTATGCGCTTACTTCGTCTAAGCCTTTTGACTACTGGGGTCAGGGAA
CCCTGGTCACCGTCTCGAGC

BMS2h-56 (SEQ ID NO: 678)
GAGGTGCAGCTGTTGGAGTCTGGGGGAGGCTTGGTACAGCCTGGGGGGT
CCCTGCGTCTCTCCTGTGCAGCCTCCGGATTCACCTTTAATGATTATAC
TATGGGTTGGGTCCGCCAGGCTCCAGGGAAGGGTCTAGAGTGGGTCTCA
TGGATTCATGGGACTGGTGGTCAGACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
GCTTTGGCTGATAGGAGTGGGGGGGTTGTTGAGTTTGACTACTGGGGTC
AGGGAACCCTGGTCACCGTCTCGAGC

TABLE 2-continued

Human Anti-CD40L VH Domain Encoding Nucleotide Sequences

BMS2h-560 (SEQ ID NO: 679)
GAGGTGCAGCTGTTGGAGTCTGGGGGAGGCTTGGTACAGCCTGGGGGGT
CCCTGCGTCTCTCCTGTGCAGCCTCCGGATTCACCTTTGAGGCGGAGAC
GATGGCTTGGGTCCGCCAGGCTCCAGGGAAGGGTCTAGAGTGGGTCTCA
TGTATTAGTAATGATGGTAATACGACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
GAGTCTCTGATTAGTCCTGGTCTTTTTGACTACTGGGGTCAGGGAACCC
TGGTCACCGTCTCGAGC

BMS2h-561 (SEQ ID NO: 680)
GAGGTGCAGCTGTTGGAGTCTGGGGGAGGCTTGGTACAGCCTGGGGGGT
CCCTGCGTCTCTCCTGTGCAGCCTCCGGATTCACCTTTGAGGTCGTAGTA
TATGAATTGGGTCCGCCAGGCTCCAGGGAAGGGTCTAGAGTGGGTCTCA
ACTATTAATGAGACTGGTTATATGACATACTACGCAGACTCCGTGAAGG
GCCGGTTCACCATCTCCCGCGACAATTCCAAGAACACGCTGTATCTGCA
AATGAATAGCCTGCGTGCCGAGGACACCGCGGTATATTACTGTGCGAAA
CTTTCTACGAGGGGGGTGCCTTTTGACTACTGGGGTCAGGGAACCCTGG
TCACCGTCTCGAGC

BMS2h-562 (SEQ ID NO: 681)
GAGGTGCAGCTGTTGGAGTCTGGGGGAGGCTTGGTACAGCCTGGGGGGT
CCCTGCGTCTCTCCTGTGCAGCCTCCGGATTCACCTTTAGGTCGTATGA
TATGGGTTGGGTCCGCCAGGCTCCAGGGAAGGGTCTAGAGTGGGTCTCA
ACGATTTCGCCTATGGGTGTTTTTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
TCTAATCAGCATGCTCATGATCCTTTTTGACTACTGGGGTCAGGGAACCC
TGGTCACCGTCTCGAGC

BMS2h-563 (SEQ ID NO: 682)
GAGGTGCAGCTGTTGGAGTCTGGGGGAGGCTTGGTACAGCCTGGGGGGT
CCCTGCGTCTCTCCTGTGCAGCCTCCGGATTCACCTTTAGTGATTATGA
TATGGGTTGGGTCCGCCAGGCTCCAGGGAAGGGTCTAGAGTGGGTCTCA
AGTATTTCGCCTATGGGTACGTTTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
GCTGCTTTGACTGAGCCTATGTTTGACTACTGGGGTCAGGGAACCCTGG
TCACCGTCTCGAGC

BMS2h-564 (SEQ ID NO: 683)
GAGGTGCAGCTGTTGGAGTCTGGGGGAGGCTTGGTACAGCCTGGGGGGT
CCCTGCGTCTCTCCTGTGCAGCCTCCGGATTCACCTTTCGTGATTATGA
TATGGGTTGGGTCCGCCAGGCTCCAGGGAAGGGTCTAGAGTGGGTCTCA
ACTATTTCTCCTCTTGGTCATTTTACATACTACGCAGACTCCGTGAAGG
GCCGGTTCACCATCTCCCGCGACAATTCCAAGAACACGCTGTATCTGCA
AATGAACAGCCTGCGTGCCGAGGATACCGCGGTATATTACTGTGCGAAA
GCTGAGGAGGCTTTTGACTACTGGGGTCAGGGAACCCTGGTCACCGTCT
CGAGC

BMS2h-565 (SEQ ID NO: 684)
GAGGTGCAGCTGTTGGAGTCTGGGGGAGGCTTGGTACAGCCTGGGGGGT
CCCTGCGCCTCTCCTGTGCAGCCTCCGGATTCGCCTTTCCTAGGTATGG
TATGACGTGGGTCCGCCAGGCTCCAGGGAAGGGTCTAGAGTGGGTCTCA
AATATTGATCAGTTTGGTATGAAGACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
GAGTATGCTTCGTTTGACTACTGGGGTCAGGGAACCCTGGTCACCGTCT
CGAGC

BMS2h-566 (SEQ ID NO: 685)
GAGGTGCAGCTGTTGGAGTCTGGGGGAGGCTTGGTACAGCCTGGGGGGT
CCCTGCGTCTCTCCTGTGCAGCCTCCGGATTCACCTTTGATAAGTATGA
TATGGGTTGGGTCCGCCAGGCTCCAGGGAAGGGTCTAGAGTGGGTCTCA
ACGATTTCGCCTATGGGTGTTTTTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
GGGCGGGGTAATACTTCGGATTTTGACTACTGGGGTCAGGGAACCCTGG
TCACCGTCTCGAGC

BMS2h-567 (SEQ ID NO: 686)
GAGGTGCAGCTGTTGGAGTCTGGGGGAGGCTTGGTACAGCCTGGGGGGT
CCCTGCGTCTCTCCTGTGCAGCCTCCGGATTCACCTTTAGTAATTATGA
TATGGCGTGGGTCCGCCAGGCTCCAGGGAAGGGTCTAGAGTGGGTCTCA
ACTATTTCTGGGGCGGTCATTTTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
AGTTTTCCGCGTGATGAGTTTGACTACTGGGGTCAGGGAACCCTGGTCA
CCGTCTCGAGC

BMS2h-568 (SEQ ID NO: 687)
GAGGTGCAGCTGTTGGAGTCTGGGGGAGGCTTGGTACAGCCTGGGGGGT
CCCTGCGTCTCTCCTGTGCAGCCTCCGGATTCACCTTTCCGAAGTATGA
GATGAGGTGGGTCCGCCAGGCTCCAGGGAAGGGTCTAGAGTGGGTCTCA
GAGATTGGTCTGGATGGTTCGCCTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
TTGGGGGATCCGAATGGTTTTTGACTACTGGGGTCAGGGAACCCTGGTCA
CCGTCTCGAGC

BMS2h-569 (SEQ ID NO: 688)
GAGGTGCAGCTGTTGGAGTCTGGGGGAGGCTTGGTACAGCCTGGGGGGT
CCCTGCGTCTCTCCTGTGCAGCCTCCGGATTCACCTTTCCGACTAGTGA
GATGATTTGGGTCCGCCAGGCTCCAGGGAAGGGTCTGGAGTGGGTCTCA
GGTATTGGGCTCTGATGGTTTGACTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
CATGGCGGATTGGTTTGACTACTGGGGTCAGGGAACCCTGGTCACCGTCT
CGAGC

BMS2h-57 (SEQ ID NO: 689)
GAGGTGCAGCTGTTGGAGTCTGGGGGAGGCTTGGTACAGCCTGGGGGGT
CCCTGCGTCTCTCCTGTGCAGCCTCCGGATTCACCTTTTCTGAGTATGA
TATGTATTGGGTCCGCCAGGCTCCAGGGAAGGGTCTAGAGTGGGTCTCA
TGGATTGATACTGATGGTGGGATACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
CCTGGTCTGAAGTTTGACTACTGGGGTCAGGGAACCCTGGTCACCGTCT
CGAGC

BMS2h-570 (SEQ ID NO: 690)
GAGGTGCAGCTGTTGGAGTCTGGGGGAGGCCTGGTACAGCCTGGGGGGT
CCCTGCGTCTCTCCTGTACAGCCTCCGGATTCACCTTTGAGAATGCTTC
TATGCAGTGGGTCCGCCAGGCTCCAGGGAAGGGTCTAGAGTGGGTCTCA
TCTATTGAGGGGCAGGGTAATGCTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
AGTTCGTCTTGGTCTTTTGACTACTGGGGTCAGGGAACCCTGGTCACCG
TCTCGAGC

BMS2h-571 (SEQ ID NO: 691)
GAGGTGCAGCTGTTGGAGTCTGGGGGAGGCTTGGTACAGCCTGGGGGGT
CCCTGCGTCTCTCCTGTGCAGCCTCCGGATTCACCTTACGCGTAATGA
GATGGGTGGGTCCGCCAGGCTCCAGGGAAGGGTCTAGAGTGGGTCTCA
ACTATTACGCCGACTGGTACGTTTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
ACGGATCCTGGTAATAGGTATTTTGACTACTGGGGTCAGGGAACCCTGG
TCACCGTCTCGAGC

BMS2h-572 (SEQ ID NO: 692)
GAGGTGCAGCTGTTGGAGTCTGGGGGAGGCTTGGTACAGCCTGGGGGGT
CCCTGCGTCTCTCCTGTGCAGCCTCCGGATTCACCTTTAATTGGCAGCT
GATGGGTTGGGTCCGCCAGGCTCCAGGGAAGGGTCTAGAGTGGGTCTCA
GGTATTGAGGGTCCTGGTGATGTTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
GTTGGGAAGGAGAGTAATTTTGACTACCGGGGTCAGGGAACCCTGGTCA
CCGTCTCGAGC

BMS2h-572-1 (SEQ ID NO: 693)
GAGGTGCAGCTGTTGGAGTCTGGGGGAGGCTTGGTACAGCCTGGGGGGT
CCCTGCGTCTCTCCTGTGCAGCCTCCGGATTCACCTTTAATTGGCAGCT
GATGGGTTGGTTCCGCCAGGCTCCAGGGAAGGGTCTAGAGTGGGTCTCA
GGTATTGAGGGTCCTGGTGATGTTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
GTTGGGAAGGAGAGTAATTTTGACTACCGGGGTCAGGGGACCCTGGTCA
CCGTCTCGAGC

BMS2h-572-10 (SEQ ID NO: 694)
GAGGTGCAGCTGTTGGAGTCTGGTGGAGGCTTGGTACAGCCTGGGGGGT
CCCTGCGTCTCTCCTGTGCAGCCTCCGGATTCACCTTTAATTGGCAGCT

TABLE 2-continued

Human Anti-CD40L VH Domain Encoding Sequences

GATGGGTTGGGTCCGCCAGGCTCCAGGGAAGGGTCTAGAGTGGGTCTCA
GGTATTGAGGGTCCTGGTGATGTTACATACTACGCAGACTCCGTGAAGG
GCCGGTTCACCGTCTCCCGCGACAATTCCAAGAACACGCTGTATCTGCA
AATGAACAGCCTGCGTGCCGAGGACACCGCGGTATATTACTGTGCGAAA
GTTGGGAAGGAGAGTAATTCTGACTACCGGGGTCAGGGAACCCTGGTCA
CCGTCTCGAGC

BMS2h-572-11 (SEQ ID NO: 695)
GAGGTGCAGCTGTTGGAGTCTGGGGGAGGCTTGGTACAGCCTGGGGGGT
CCCTGCGTCTCTCCTGTGCAGCCTCAGGATTCACCTTTAATTGGCAGCT
GATGGGTTGGGTCCGCCAGGCTCCAGGGAAGGGTCTAGAGTGGGTCTCA
GGTATTGAGGGTCCTGGTGATGTTACATACTACGCAGATTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGTGAAA
GTTGGGAAGGAGAGTAATTCTGACTACCGGGGTCAGGGAACCCAGGTCA
CCGTCTCGAGC

BMS2h-572-12 (SEQ ID NO: 696)
GAGGTGCAGCTGTTGGAGTCTGGGGGAGGCTTGGTACAGCCTGGGGGGT
CCCTGCGTCTCTCCTGTGCAGCCTCCGGATTCACCTTTAATTGGCAGCT
GATGGGTTGGGCCCGCCAGGCTCCAGGGAAGGGTCTAGAGTGGGTCTCA
GGTATTGAGGGTCCTGGTGATGTTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
GTTGGGAAGGAGAGTAATTCTGACTACCGGGGTCAGGGAACCCTGGTCA
CCGTCTCGAGC

BMS2h-572-13 (SEQ ID NO: 697)
GAGGTGCAGTTGTTGGAGTCTGGGGGAGGCTTGGTACAGCCTGGGGGGT
CCCTGCGTCTCTCCTGTGCAGCCTCCGGATTCACCTTTAATTGGCAGCT
GATGGGTTGGGCCCGCCAGGCTCCAGGGAAGGGTCTAGAGTGGGTCTCA
GGTATTGAGGGTCCTGGTGATGTTACATACTACGCAGACTCCGTGAAGG
ACCGGTTCACCATCTCCCGCGACAATTCCAAGAACACGCTGTATCTGCT
AATGAACAGCCTGCGTGCCGAGGACACCGCGGTATATTACTGTGCGAAA
GTAGGGAAGGAGAGTAATTTTGACTACTGGGGTCAGGGAACCCTGGTCA
CCGTCTCGAGC

BMS2h-572-14 (SEQ ID NO: 698)
GAGGTGCAGCTGTTGGAGTCTGGGGGAGGCTTGGTACAGCCTGGGGGGT
CCCTGCGTCTCTCCTGTGCAGCCTCCGGATTCACCTTTAATTGGCAGCT
GATGGGTTGGGTCCGCCAGGCTCCAGGGAAGGGTCTAGAGTGGGTCTCA
GGCATTGAGGGTCCTGGTGATGTTACATACTACGCAGACTCAGTGAAGG
GCCGGTTCACCATCTCCCGCGACAATCCCAAGAACACGCTGTATCTGCA
AATGAACAGCCTGCGTGCCGAGGACACCGCGGTATATTACTGTGTGAAA
GTTGGGAAGGAGAGTAATTCTGACTACCGGGGTCAGGGAACCCTGGTCA
CCGTCTCGAGC

BMS2h-572-15 (SEQ ID NO: 699)
GAGGTGCGGCTATTGGAGTCTGGGGGAGGCTTGGTACAGCCTGGGGGGT
CCCTGCGTCTCTCCTGTGCAGCCTCCGGATTCAACTTTAATTGGCAGCT
GATGGGTTGGATCCGCCAGGCTCCAGGGAAGGGTCTAGAGTGGGTCTCA
GGTATTGAGGGTCCTGGTGATGTTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCAGTATATTACTGTGCGAAA
GTTGGGAAGGAGAGTAATTCTGACTACCGGGGTCAGGGAACCCTGGTCA
CCGTCTCGAGC

BMS2h-572-16 (SEQ ID NO: 700)
GAGGTGCAGCTGTTGGAGTCTGGGGGAGGCTTGGTACAGCCTGGGGGGT
CACTGCGTCTCTCCTGTGTAGCCTCCGGATTCACCTTTAATTGGCAGCT
GATGGGTTGGGTCCGCCAGGCTCCAGGGAAGGGTCTAGAGTGGGTCTCA
GGTATTGAGGGTCCTGGTGATGTTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
GTTGGGAAGGAGAGTAATTTTGACTACCGGGGTCAGGGAACCCTGGTCA
CCGTCTCGAGC

BMS2h-572-17 (SEQ ID NO: 701)
GAGGTGCAGCTGTTGGAGTCTGGGGGAGGCTTGGTACAGACTGGGGGGT
CCCTGCGTCTCTCCTGTGCAGCCTCCGGATTCACCTATAATTGGCAGCT
GATGGGTTGGGTCCGCCAGGCTCCAGGGAAGGGTCTAGAGTGGGTCTCA
GGTATTGAGGGTCCTGGTGATGTTACATACTACGCAGACTCCGTGAAGG
GCCGGTTCACCATCTCCCGCGACAATTCCAAGAACACGCTGTATCTGCA
AATGAACAGCCTGCGTGCCGATGACACCGCGGTATATTACTGTGTGAAA
GTTGGGAAGGAGAGTAATTTTGACTACCGGGGTCACGGAACCCTGGTCA
CCGTCTCGAGC

BMS2h-572-18 (SEQ ID NO: 702)
GAGGTGCAGCTGTTGGAGTCTGGGGGAGGCTTGGTACAGCCTGGGGGGT
CCCTGCGTCTCTCCTGTGCAGCCTCCGGATTCACCTTTAATTGGCAGCT
GATGGGTTGGGTCCGCAAGGCTCCTGGGAAGGGTCTAGAGTGGGTCTCA
GGTATTGAGGGTCCTGGTGATGTTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
GTTGGGAAGGAGAGTAATTTTGACTACCGGGGTCAGGGAACCCTGGTCA
CCGTCTCGAGC

BMS2h-572-19 (SEQ ID NO: 703)
GAGGTGCAGCTGTTGGAGTCTGGGGGAGGCTTGGTACAGCCTGGGGGGT
CCCTGCGTCTCTCCTGTGCAGCCTCCGGATTCACCTTTAATTGGCAGCT
GATGGGTTGGGTCCGCCAGGCCCCAGGGAAGGGTCTAGAGTGGGTCTCA
GGTATTGAGGGTCCTGGTGATGTTACATACTACGCAGACTCCGTGAAGG
GCCGGTTCACCATCTCCCGCGACAATACCAAGAACACGCTGTATCTGCA
AATGAACAGCCTGCGTGCCGAGGACACCGCGGTATATTACTGTGCGAAA
GTTGGGAAGGAGAGTAATTTTGACTACCGGGGTCAGGGAACCCTGGTCA
CCGTCTCGAGC

BMS2h-572-2 (SEQ ID NO: 704)
GAGGTGCAGCTGTTGGAGTCTGGGGGAGGCTTGGTACAGCCTGGGGGGT
CCCTGCGCCTCTCCTGTGCAGCCTCCGGATTCACCTTTAATTGGCAGCT
GATGGGTTGGGTCCGCCAGGCTCCAGGGAAGGGTCTTGAGTGGGTCTCA
GGTATTGAGGGTCCTGGTGATGTTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
GTTGGGAAGGAGAGTAAGTTTGACTACCTGGGTCAGGGAACCCTGGTCA
CCGTCTCGAGC

BMS2h-572-21 (SEQ ID NO: 705)
GAGGTGCAGCTGTTGGAGTCTGGGGGAGGCTTGGTACAGCCTGGGGGGT
CCCTGCGTCTCTCCTGTGCAGCCTCCGGATTCACCTTTAATTGGCAGCT
GATGGGTTGGGTCCGCCAGGCTCCAGGGAAGGGTCTAGAGTGGGTCTCA
GGTATTGAGGGTCCTGGTGATGTTACATACTACGCAGAATCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
GTTGGGAAGGAGAGTAATCTTGACTACCGGGGTCAGGGAACCCTGGTCA
CCGTCTCGAGC

BMS2h-572-22 (SEQ ID NO: 706)
GAGGTGCAGCTGTTTGAGTCTGGGGGAGGCTCGGTACAGCCTGGGGGGT
CCCTGCGTCTCTCCTGTGCAGCCTCCGGATTCACCTTTAATTGGCAGCT
GATGGGTTGGGTCCGCCAGGCTCCAGGGAAGGGTCTAGAGTGGGTCTCA
GGTATTGAGGGTCCTGGTGATGTTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
GTTGGGAAGGAGAGTAATTCTGACTACCGGGGTCAGGGGACCCTGGTCA
CCGTCTCGAGC

BMS2h-572-23 (SEQ ID NO: 707)
GAGGTGCAGCTGTTGGAGTCTGGGGGAGGCTTGGTACAGCCTGGGGGGT
CCCTGCGTCTCACCTGTGCAGCCTCCGGATTCACCTTTAATTGGCAGCT
GATGGGTTGGGTCCGCCAGGCTCCAGGGAAGGGTCTAGAGTGGGTCTCG
GGTATTGAGGGTCCTGGTGATGTTACATACTACGCAGACTCCGTGAAGG
GCCGGTTCATCATCTCCCGCGACAATTCCAAGAACACGCTATATCTGCA
AATGAACAGCCTGCGTGCCGAGGACACCGCGGTATATTACTGTGCGAAA
GTTGGGAAGGAGAGTAATTCTGACTACCGGGGTCAGGGAACCCTGGTCA
CCGTCTCGAGC

BMS2h-572-24 (SEQ ID NO: 708)
GAGGTGCAGCTGTTGGAGTCTGGGGGAGGCTTGGTACAGCCTGGGGGGT
CCCTGCGTCTCTCCTGTGCAGCCTCCGGATTCACCTTTAATTGGCAGCT
GATGGGTTGGGTCCGCCAGGCTCCAGGGAAGGGTCTAGAGTGGGTCTCA
GGTATTGAGGGTCCTGGTGATGTTACATACTACGCAGACTCCGTGAAGG
GCCGGTTCACCATCTCCCGCGACAATTCCACGAACACGCTGTATCTGCA
AATGAACAGCCTGCGTGCCGAGGACACCGCGGTATATTACTGTGCGAAA
GTTGGGAAGGAGAGTAATTTGACTACCGGGGTCAGGGAACCCTGGTCA
CCGTCTCGAGC

BMS2h-572-3 (SEQ ID NO: 709)
GAGGTGCAGCTGTTGGAGTCTGGGGGAGGCTTGGTACAGCCTGGGGGGT
CCCTGCGTCTCTCCTGTGCAGCCTCCGGATTCACCTTTAATTGGCAGCT
GATGGGTTGGGTCCGCCAGGCTCCAGGGAAGGGTCTAGAGTGGGTCTCA
GGTATTGAGGGTCCTGGTGATGTTACATACTACGCAGACTCCGTGAAGG
GCCGGTTCACCATCACCCGCGACAATTCCAAGAACACGCTGTATCTGCA
AATGAACAGCCTGCGTGCCGAGGACACCGCGGTATATTACTGTGTGAAA

TABLE 2-continued

Human Anti-CD40L VH Domain Encoding Nucleotide Sequences

GTTGGGAAGGAGAGTAATCTTGACTACCGGGGTCAGGGAACCCTGGTCA
CCGTCTCGAGC

BMS2h-572-4 (SEQ ID NO: 710)
GAGGTGCAGCTGTTGGTGTCTGGGGGAGGCCTGGTACAGCCTGGGGGGT
CCCTGCGTCTCTCCTGTGCAGCCTCCGGATTCACCTTTAATTGGCAGCT
GATGGGTTGGGTCCGCCAGGCTCCAGGGAAGGGTCTAGAGTGGGTCTCA
GGTATTGAGGGTCCTGGTGATGTTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGTGAAA
GTTGGGAAGGAGAGTAATTTTGACTACCGGGGTCAGGGAACCCTGGTCA
CCGTCTCGAGC

BMS2h-572-5 (SEQ ID NO: 711)
GAGGTGCAGCTGTTGGTGTCTGGGGGAGGCTTGGTACAGCCTGGGGGGT
CCCTGCGTCTCTCCTGTGCAGCCTCCGGATTCACCTTTAATTGGCAGCT
GATGGGTTGGGTCCGCCAGGCTCCAGGGAAGGGTCTAGAGTGGGTCTCA
GGTATTGAGGGTCCTGGTGATGTTACATACTACGCAGACTCCGTGAAGG
GCCGGTTCACCATCTCCCGCGACAATTCCAAGAACATGCTGTATCTGCA
AATGAACAGCCTGCGTGCCGAGGACACCGCGGTATATTACTGTGCGAAA
GTTGGGAAGGAGAGTAATTTTGACTACCGGGGTCAGGGAACCCTGGTCA
CCGTCTCGAGC

BMS2h-572-6 (SEQ ID NO: 712)
GAGGTGCAGCTGTTGGAGTCTGGGGGAGGCTTGGTACAGCCTGGGGGGT
CCCTGCGTCTCTCCTGTGCAGCCTCCGGATTCACCTTTAATTGGCAGCT
GATGGGTTGGGTCCGGCAGGCTCCAGGGAAGGGTCTAGAGTGGGTCTCA
GGTATTGAGGGTCCAGGTGATGTTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGTGAAA
GTTGGGAAGGAGAGTAATTCTGACTACCGGGGTCAGGGAACCCTGGTCA
CCGTATCGAGC

BMS2h-572-601 (SEQ ID NO: 713)
GAGGTGCAGCTGTTGGAGTCTGGGGGAGGCTTGGTACAGCCTGGGGGGT
CCCTGCGTCTCTCCTGTGCAGCCTCCGGATTCACCTTTAAGTGGCAGCT
CATGGGGTGGGCCCGGCAGGCTCCAGGGAAGGGTCTAGAGTGGGTCTCA
GGTATTGAGGGTCCAGGTGATGTTACATACTACGCAGACCCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGTGAAA
GTTGGGAAGGAGAGTAATTCTGACTACCGGGGTCAGGGAACCCTGGTCA
CCGTATCGAGC

BMS2h-572-602 (SEQ ID NO: 714)
GAGGTGCAGCTGTTGGAGTCTGGGGGAGGCTTGGTACAGCCTGGGGGGT
CCCTGCGTCTCTCCTGTGCAGCCTCCGGATTCACCTTTAAGTGGCACCT
GATGGGGTGGGTCCGGCAGGCTCCAGGGAAGGGTCTAGAGTGGGTCTCA
GGTATTGAGGGTCCAGGTGATGTTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGTGAAA
GTTGGGAAGGAGAGTAGTTCTGACTACCGGGGTCAGGGAACCCTGGTCA
CCGTATCGAGC

BMS2h-572-603 (SEQ ID NO: 715)
GAGGTGCAGCTGTTGGAGTCTGGGGGAGGCTTGGTACAGCCTGGGGGGT
CCCTGCGTCTCTCCTGTGCAGCCTCCGGATTCACCTTTAACTGGCACCT
GATGGCCTGGGCCCGGCAGGCTCCAGGGAAGGGTCTAGAGTGGGTCTCA
GGTATTGAGGGTCCAGGTGATGTTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGTGAAA
GTTGGGAAGGAGAGTAATTCTGACTACCGGGGTCAGGGAACCCTGGTCA
CCGTATCGAGC

BMS2h-572-604 (SEQ ID NO: 716)
GAGGTGCAGCTGTTGGAGTCTGGGGGAGGCTTGGTACAGCCTGGGGGGT
CCCTGCGTCTCTCCTGTGCAGCCTCCGGATTCACCTTTAAGTGGCAGCT
GATGGGCTGGGTCCGGCAGGCTCCAGGGAAGGGTCTCGAGTGGGTCTCA
GGTATTGAGGGTCCAGGTGATGTTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGTGAAA
GTTGGGAAGGAGAGTAATTCTGACTACCGGGGTCAGGGAACCCTGGTCA
CCGTATCGAGC

BMS2h-572-605 (SEQ ID NO: 717)
GAGGTGCAGCTGTTGGAGTCTGGGGGAGGCTTGGTGCAGCCTGGGGGGT
CCCTGCGTCTCTCCTGTGCAGCCTCCGGATTCACCTTTAAGTGGCAGCT
GATGGCCTGGGCCCGGCAGGCTCCAGGGAAGGGTCTAGAGTGGGTCTCA
GGTATTGAGGGTCCAGGTGATATTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGTGAAA
GTTGGGAAGGAGAGTAATTCTGACTACCGGGGTCAGGGAACCCTGGTCA
CCGTATCGAGC

BMS2h-572-606 (SEQ ID NO: 718)
GAGGTGCAGCTGTTGGAGTCTGGGGGAGGCTTGGTACAGCCTGGGGGGT
CCCTGCGTCTCTCCTGTGCAGCCTCCGGATTCACCTTTAACTGGCACTT
GATGGGCTGGGCCCGGCAGGCTCCAGGGAAGGGTCTAGAGTGGGTCTCA
GGTATTGAGGGTCCAGGTGATGTTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGTGAAA
GTTGGGAAGGAGAGTAATTCTGACTACCGGGGTCAGGGAACCCTGGTCA
CCGTATCGAGC

BMS2h-572-607 (SEQ ID NO: 719)
GAGGTGCAGCTGTTGGAGTCTGGGGGAGGCTTGGTACAGCCTGGGGGGT
CCCTGCGTCTCTCCTGTGCAGCCTCCGGATTCACCTTTAAGTGGCAGCT
CATGGGGTGGGCCCGGCAGGCTCCAGGGAAGGGTCTAGAGTGGGTCTCA
GGTATTGAGGGTCCAGGTGATGTTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGTGAAA
GTTGGGAAGGAGAGTAATTCTGACTACCGGGGTCAGGGAACCCTGGTCA
CCGTATCGAGC

BMS2h-572-608 (SEQ ID NO: 720)
GAGGTGCAGCTGTTGGAGTCTGGGGGAGGCTTGGTACAGCCTGGGGGGT
CCCTGCGTCTCTCCTGTGCAGCCTCCGGATTCACCTTTAACTGGGAGCT
GATGGGCTGGGCCCGGCAGGCTCCAGGGAAGGGTCTAGAGTGGGTCTCA
GGTATTGAGGGTCCAGGTGATTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGTGAAA
GTTGGGAAGGAGAGTAATTCTGACTACCGGGGTCAGGGAACCCTGGTCA
CCGTATCGAGC

BMS2h-572-609 (SEQ ID NO: 721)
GAGGTGCAGCTGTTGGAGTCTGGGGGAGGCTTGGTACAGCCTGGGGGGT
CCCTGCGTCTCTCCTGTGCAGCCTCCGGATTCACCTTTAACTGGCAGCT
CATGGGGTGGGCCCGGCAGGCTCAGGGAAGGGTCTAGAGTGGGTCTCA
GGTATTGAGGGTCCAGGTGATGTTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGTGAAA
GTTGGGAAGGAGAGTAATTCTGACTACCGGGGTCAGGGAACCCTGGTCA
CCGTATCGAGC

BMS2h-572-610 (SEQ ID NO: 722)
GAGGTGCAGCTGTTGGAGTCTGGGGGAGGCTTGGTACAGCCTGGGGGGT
CCCTGCGTCTCTCCTGTGCAGCCTCCGGATTCACCTTTAATTGGCAGCT
GATGGGTTGGGTCCGGCAGGCTCCAGGGAAGGGTCTAGAGTGGGTCTCA
GGTATTGAGGGTCCAGGTGATGTTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGTGAAA
GTGGGCAAGGACAGCAAGTCGGACTACCGGGGTCAGGGAACCCTGGTCA
CCGTATCGAGC

BMS2h-572-611 (SEQ ID NO: 723)
GAGGTGCAGCTGTTGGAGTCTGGGGGAGGCTTGGTACAGCCTGGGGGGT
CCCTGCGTCTCTCCTGTGCAGCCTCCGGATTCACCTTTAATTGGCAGCT
GATGGTTGGGTCCGGCGGGCTCCAGGGAAGGGTCTAGAGTGGGTCTCA
GGTATTGAGGGTCCAGGTGATGTTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGTGAAA
GTCGGGAAGGACAGCAAGTCGGACTACCGGGGTCAGGGAACCCTGGTCA
CCGTATCGAGC

BMS2h-572-612 (SEQ ID NO: 724)
GAGGTGCAGCTGTTGGAGTCTGGGGGAGGCTTGGTACAGCCTGGGGGGT
CCCTGCGTCTCTCCTGTGCAGCCTCCGGATTCACCTTTAATTGGCAGCT
GATGGGTTGGGTCCGGCAGGCTCCAGGGAAGGGTCTAGAGTGGGTCTCA
GGTATTGAGGGTCCAGGTGATGTTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGTGAAA
GTCGGGAAGGACAGCAACTCGGACTACCGGGGTCAGGGAACCCTGGTCA
CCGTATCGAGC

TABLE 2-continued

Human Anti-CD40L VH Domain Encoding Nucleotide Sequences

BMS2h-572-613 (SEQ ID NO: 725)
GAGGTGCAGCTGTTGGAGTCTGGGGGAGGCTTGGCACAGCCTGGGGGGT
CCCTGCGTCTCTCCTGTGCAGCCTCCGGATTCACCTTTAATTGGCAGCT
GATGGGTTGGGTCCGGCAGGCTCCAGGGAAGGGTCTAGAGTGGGTCTCA
GGTATTGAGGGTCCAGGTGATGTTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGTGAAA
GTGGGCAAGGACAGCAAGTCCGACTACCGGGGTCAGGGAACCCTGGTCA
CCGTATCGAGC

BMS2h-572-614 (SEQ ID NO: 726)
GAGGTGCAGCTGTTGGAGTCTGGGGGAGGCTTGGTACAGCCTGGGGGGT
CCCTGCGTCTCTCCTGTGCAGCCTCCGGATTCACCTTTAATTGGCAGCT
GATGGGTTGGGTCCGGCAGGCTCCAGGGAAGGGTCTAGAGTGGGTCTCA
GGTATTGAGGGTCCAGGTGATGTTACATACTACGCAGACTCCGTGAAGG
GCCGGTTCACCATCTCCCGCGACAATTCCAAGAACACGCTGTATCTGCA
AATGAACAGCCTGCGTGCCGAGGATACCGCGGTATATTACTGTGTGAAG
GTGGGGAAGGACCAAGTCGGACTACCGGGGTCAGGGAACCCTGGTCA
CCGTATCGAGC

BMS2h-572-615 (SEQ ID NO: 727)
GAGGTGCAGCTGTTGGAGTCTGGGGGAGGCTTGGTACAGCCTGGGGGGT
CCCTGCGTCTCTCCTGTGCAGCCTCCGGATTCACCTTTAATTGGCAGCT
GATGGGTTGGGTCCGGCAGGCTCCAGGGAAGGGTCTAGAGTGGGTCTCA
GGTATTGAGGGCCCAGGTGATGTTACATACTACGCAGACTCCGTGAAGG
GCCGGTTCACCATCTCCCGCGACAATTCCAAGAACACGCTGTATCTGCA
AATGAACAGCCTGCGTGCCGAGGATACCGCGGTATATTACTGTGTGAAA
GTGGGGAAGGACAAGAACTCGGACTACCGGGGTCAGGGAACCCTGGTCA
CCGTATCGAGC

BMS2h-572-616 (SEQ ID NO: 728)
GAGGTGCAGCTGTTGGAGTCTGGGGGAGGCTTGGTACAGCCTGGGGGGT
CCCTGCGTCTCTCCTGTGCAGCCTCCGGATTCACCTTTAATTGGCAGCT
GATGGGTTGGGTCCGGCAGGCTCCAGGGAAGGGTCTAGAGTGGGTCTCA
GGTATTGAGGGTCCAGGTGATGTTACATACTACGCAGACTCCGTGAAGG
GCCGGTTCACCATCTCCCGCGACAATTCCAAGAACACGCTGTATCTGCA
AATGAACAGCCTGCGTGCCGAGGATACCGCGGTATATTACTGTGTGAAA
GTGGGAAGGAGAGCAAGTCCGACTACCGGGGTCAGGGAACCCTGGTCA
CCGTATCGAGC

BMS2h-572-617 (SEQ ID NO: 729)
GAGGTGCAGCTGTTGGAGTCTGGGGGAGGCTTGGTACAGCCTGGGGGGT
CCCTGCGTCTCTCCTGTGCAGCCTCCGGATTCACCTTTAATTGGCAGCT
GATGGGTTGGGTCCGGCAGGCTCCAGGGAAGGGTCTAGAGTGGGTCTCA
GGTATTGAGGGTCCAGGTGATGTTACATACTACGCAGACTCCGTGAAGG
GCCGGTTCACCATCTCCCGCGACAATTCCAAGAACACGCTGTATCTGCA
AATGAACAGCCTGCGTGCCGAGGATACCGCGGTATATTACTGTGTGAAA
GTGGGAGGGACAGCAAGTCGGACTACCGGGGTCAGGGAACCCTGGTCA
CCGTATCGAGC

BMS2h-572-618 (SEQ ID NO: 730)
GAGGTGCAGCTGTTGGAGTCTGGGGGAGGCTTGGTACAGCCTGGGGGGT
CCCTGCGTCTCTCCTGTGCAGCCTCCGGATTCACCTTTAATTGGCAGCT
GATGGGTTGGGTCCGGCAGGCTCCAGGGAAGGGTCTAGAGTGGGTCTCA
GGTATTGAGGGTCCAGGTGATGTTACATACTACGCGGACTCCGTGAAGG
GCCGGTTCACCATCTCCCGCGACAATTCCAAGAACACGCTGTATCTGCA
AATGAACAGCCTGCGTGCCGAGGATACCGCGGTATATTACTGTGTGAAA
GTCGGGAAGTACAGCAACTCGGACTACCGGGGTCAGGGAACCCTGGTCA
CCGTATCGAGC

BMS2h-572-619 (SEQ ID NO: 731)
GAGGTGCAGCTGTTGGAGTCTGGGGGAGGCTTGGTACAGCCTGGGGGGT
CCCTGCGTCTCTCCTGTGCAGCCTCCGGATTCACCTTTAATTGGCAGCT
GATGGGTTGGGTCCGGCAGGCTCCAGGGAAGGGTCTAGAGTGGGTCTCA
GGTATTGAGGGTCCAGGTGATGTTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGTGAAA
GTGGGCAAGGACAGGTCGGACTACCGGGGTCAGGGAACCCTGGTCA
CCGTATCGAGC

BMS2h-572-620 (SEQ ID NO: 732)
GAGGTGCAGCTGTTGGAGTCTGGGGGAGGCTTGGTACAGCCTGGGGGGT
CCCTGCGTCTCTCCTGTGCAGCCTCCGGATTCACCTTTAATTGGCAGCT
GATGGGTTGGGTCCGGCAGGCTCCAGGGAAGGGTCTAGAGTGGGTCTCA
GGTATTGAGGGTCCAGGTGATGTTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGTGAAA
GTGGGGAAGGACGACAGCTCGGACTACCGGGGTCAGGGAACCCTGGTCA
CCGTATCGAGC

BMS2h-572-621 (SEQ ID NO: 733)
GAGGTGCAGCTGTTGGAGTTTGGGGGAGGCTTGGTACAGCCTGGGGGGT
CCTTGCGTTTTTCCTGTGCAGCTTCCGGATTCACCTTTAATTGGCAGCT
GATGGGTTGGTTCCGGCAGGCTCCAGGGAAGGGTTTAGAGTGGGTTTCA
GGTATTGAGGGTCCAGGTGATGTTACATATTACGCAGATTCCGTGAAGG
GCCGGTTCACCATTTCCCGCGACAATTCCAAGAACACGCTGTATCTGCA
AATGAACACCTTGCGTGCCGAGGATACCGCGGTATATTACTGTGTGAAA
GTGGGGAGGGACAGCAATTCCGACTACCGGGGTCAGGGAACCCTGGTCA
CCGTATCGAGC

BMS2h-572-622 (SEQ ID NO: 734)
GAGGTGCAGCTGTTGGAGTCTGGGGGAGGCTTGGTACAGCCTGGGGGGT
CCCTGCGTCTCTCCTGTGCAGCCTCCGGATTCACCTTTAATTGGCAGCT
GATGGGTTGGGTCCGGCAGGCTCCAGGGAAGGGTCTAGAGTGGGTCTCA
GGTATTGAGGGTCCAGGTGATGTTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGTGAAA
GTGGGGAAGGACAGCACCTCGGACTACCGGGGTCAGGGAACCCTGGTCA
CCGTATCGAGC

BMS2h-572-623 (SEQ ID NO: 735)
GAGGTGCAGCTGTTGGAGTCTGGGGGAGGCTTGGTACAGCCTGGGGGGT
CCCTGCGTCTCTCCTGTGCAGCCTCCGGATTCACCTTTAATTGGCAGCT
GATGGGTTGGGTCCGGCAGGCTCCAGGGAAGGGTCTAGAGTGGGTCTCA
GGTATTGAGGGTCCAGGTGATGTTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGTGAAA
GTGGGGAAGGAGAGCAGCTCGGACTACCGGGGTCAGGGAACCCTGGTCA
CCGTATCGAGC

BMS2h-572-624 (SEQ ID NO: 736)
GAGGTGCAGCTGTTGGAGTCTGGGGGAGGCTTGGTACAGCCTGGGGGGT
CCCTGCGTCTCTCCTGTGCAGCCTCCGGATTCACCTTTAATTGGCAGCT
GATGGGTTGGGTCCGGCAGGCTCCAGGGAAGGGTCTAGAGTGGGTCTCA
GGTATTGAGGGTCCAGGTGATGTTACATACTACGCAGACTCCGTGAAGG
GCCGGTTCACCATCTTCCCGCGACAATTCCAAGAACACGCTGTATCTGCA
AATGAACAGCCTGCGTGCCGAGGATACCGCGGTATATTACTGTGTGAAA
GTGGGCAAGGACAGCGCGTCCGACTACCGGGGTCAGGGAACCCTGGTCA
CCGTATCGAGC

BMS2h-572-625 (SEQ ID NO: 737)
GAGGTGCAGCTGTTGGAGTCTGGGGGAGGCTTGGTACAGCCTGGGGGGT
CCCTGCGTCTCTCCTGTGCAGCCTCCGGATTCACCTTTAATTGGCAGCT
GATGGGTTGGGTCCGGCAGGCTCCAGGGAAGGGTCTAGAGTGGGTCTCA
GGTATTGAGGGTCCAGGTGATGTTACATACTACGCAGACTCCGTGAAGG
GCCGGTTCACCATCTCCCGCGACAATTCCAAGAACACGCTGTATCTGCA
AATGAACAGCCTGCGTGCCGAGGATACCGCGGTATATTACTGTGTGAAA
GTCGGCAACGACAGCTACTCGGACTACCGGGGTCAGGGAACCCTGGTCA
CCGTATCGAGC

BMS2h-572-626 (SEQ ID NO: 738)
GAGGTGCAGCTGTTGGAGTCTGGGGGAGGCTTGGTACAGCCTGGGGGGT
CCCTGCGTCTCTCCTGTGCAGCCTCTGGATTCACCTTTAATTGGCAGCT
GATGGGTTGGGTCCGGCAGGCTCCAGGGAAGGGTCTAGAGTGGGTCTCA
GGTATTGAGGGTCCAGGTGATGTTACATACTACGCAGACTCCGTGAAGG
GCCGGTTCACCATCTCCCGCGACAATTCCAAGAACACGCTGTATCTGCA
AATGAACGCCTGCGTGCCGAGGACACCGCGGTATATTACTGTGTGAAA
GTGGGGAAGGACAGCAGCTCGGACTACCGGGGTCAGGGAACCCTGGTCA
CCGTATCGAGC

BMS2h-572-627 (SEQ ID NO: 739)
GAGGTGCAGCTGTTGGAGTCTGGGGGAGGCTTGGTACAGCCTGGGGGGT
CCCTGCGTCTCTCCTGTGCAGCCTCCGGATTCACCTTTAATTGGCAGCT
GATGGGTTGGGTCCGGCAGGCTCCAGGGAAGGGTCTAGAGTGGGTCTCA
GGTATTGAGGGTCCAGGTGATGTTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGATATATTACTGTGTGAAA
GTGGGCAAGGACAGCGCGTCGGACTACCGGGGTCAGGGAACCCTGGTCA
CCGTATCGAGC

BMS2h-572-630 (SEQ ID NO: 740)
GAGGTGCAGCTGTTGGAGTCTGGGGGAGGCTTGGTACAGCCTGGGGGGT
CCCTGCGTCTCTCCTGTGCAGCCTCCGGATTCACCTTTAAGTGGCAGCT

TABLE 2-continued

Human Anti-CD40L VH Domain Encoding Nucleotide Sequences

GATGGGCTGGGTCCGGCAGGCTCCAGGGAAGGGTCTAGAGTGGGTCTCA
GGTATTGAGGGTCCAGGTGATGTTACATACTACGCAGACTCCGTGAAGG
GCCGGTTCACCATCTCCCGCGACAATTCCAAGAACACGCTGTATCTGCA
AATGAACAGCCTGCGTGCCGAGGATACCGCGGTATATTACTGTGTGAAA
GTGGGGAAGGACGCCAAGTCGGACTACCGGGGTCAGGGAACCCTGGTCA
CCGTATCGAGC

BMS2h-572-631 (SEQ ID NO: 741)
GAGGTGCAGCTGTTGGAGTCTGGGGGAGGCTTGGTACAGCCTGGGGGGT
CCCTGCGTCTCTCCTGTGCAGCCTCCGGATTCACCTTTAAGTGGCAGCT
GATGGGCTGGGTCCGGCAGGCTCCAGGGAAGGGTCTAGAGTGGGTCTCA
GGTATTGAGGGTCCAGGTGATGTTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGTGAAA
GTGGGCAAGGACAGCAGGTCGGACTACCGGGGTCAGGGAACCCTGGTCA
CCGTATCGAGC

BMS2h-572-632 (SEQ ID NO: 742)
GAGGTGCAGCTGTTGGAGTCTGGGGGAGGCTTGGTACAGCCTGGGGGGT
CCCTGCGTCTCTCCTGTGCAGCCTCCGGATTCACCTTTAAGTGGCAGCT
GATGGGCTGGGTCCGGCAGGCTCCAGGGAAGGGTCTAGAGTGGGTCTCA
GGTATTGAGGGTCCAGGTGATGTTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGTGAAA
GTGGGCAAGGACAGCAAGTCCGACTACCGGGGTCAGGGAACCCTGGTCA
CCGTATCGAGC

BMS2h-572-633 (SEQ ID NO: 743)
GAGGTGCAGCTGTTGGAGTCTGGGGGAGGCTTGGTACAGCCTGGGGGGT
CCCTGCGTCTCTCCTGTGCAGCCTCCGGATTCACCTTTAACTGGCAGCT
GATGGGCTGGGCCCGGCAGGCTCCAGGGAAGGGTCTAGAGTGGGTCTCA
GGTATTGAGGGTCCAGGTGATGTTACATACTACGCAGACTCCGTGAAGG
GCCGGTTCACCATCTCCCGCGACAATTCCAAGAACACGCTGTATCTGCA
AATGAACAGCCTGCGTGCCGAGGATACCGCGGTATATTACTGTGTGAAA
GTGGGGAAGGACGCCAAGTCGGACTACCGGGGTCAGGGAACCCTGGTCA
CCGTATCGAGC

BMS2h-572-634 (SEQ ID NO: 744)
GAGGTGCAGCTGTTGGAGTCTGGGGGAGGCTTGGTACAGCCTGGGGGGT
CCCTGCGTCTCTCCTGTGCAGCCTCCGGATTCACCTTTAACTGGGAGCT
GATGGGCTGGGCCCGGCAGGCTCCAGGGAAGGGTCTAGAGTGGGTCTCA
GGTATTGAGGGTCCAGGTGATGTTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGTGAAA
GTGGGCAAGGACAGCAGGTCGGACTACCGGGGTCAGGGAACCCTGGTCA
CCGTATCGAGC

BMS2h-572-635 (SEQ ID NO: 745)
GAGGTGCAGCTGTTGGAGTCTGGGGGAGGCTTGGTACAGCCTGGGGGGT
CCCTGCGTCTCTCCTGTGCAGCCTCCGGATTCACCTTTAACTGGGAGCT
GATGGGCTGGGCCCGGCAGGCTCCAGGGAAGGGTCTAGAGTGGGTCTCA
GGTATTGAGGGTCCAGGTGATGTTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGTGAAA
GTGGGCAAGGACAGCAAGTCCGACTACCGGGGTCAGGGAACCCTGGTCA
CCGTATCGAGC

BMS2h-572-7 (SEQ ID NO: 746)
GAGGTGCAGCTGTTGGAGTCTGGGGGAGGCTTGGTACAGCCTGGGGGGT
CCCTGCGTCTCTCCTGTGCAGCCTCCGGATTCACCTTTAATTGGCAGCT
GATGGGGATGGGCCCGCCAGGCTCCAGGGAAGGGTCTAGAGTGGGTCTCA
GGTATTGAGGGTCCTGGTGATGTTACATACTACGCAGACTCCGTGAAGG
GTCGGTTCACCATCTCCCGCGACAATTCCAAGAACACGCTGTATCTACA
AATGAACAGCCTGCGTGCCGAGGACTCCGCGGTATATTACTGTGCGAAA
GTTGGGAAGGAGAGTAATTTTGACTACCTGGGTCAGGGAACCCTGGTCA
CCGTCTCGAGC

BMS2h-572-8 (SEQ ID NO: 747)
GAGGTGCAGCTGTTGGAGTCTGGGGGAGGCTTGGTACAGCCTGGGGGGT
CCCTGCGTCTCTCCTGTGTAGCCTCCGGATTCACCTTTAATTGGCAGCT
GATGGGTTGGGTCCGCCAGGCGCCAGGGAAGGGTCTAGAGTGGGTCTCA
GGTATTGAGGGTCCTGGTGATGTTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
GTCGGGAAGGAGAGTAATTCTGACTACCGGGGTCAGGGAACCCTGGTCA
CCGTTTCGAGC

BMS2h-572-9 (SEQ ID NO: 748)
GAGGTGCAGCTGTTGGAGTCTGGGGGAGGCTTGGTACAGCCTGGGGGGT
CCCTGCGTCTCTCCTGTGCAGCCTCCGGATTCACCTTTAATTGGCAGCT
GATGGGTTGGGTCCGCCAGGCTCCAGGGAAGGGTCTAGAGTGGGTCTCA
GGTATTGAGGGTCCTGGTGATGTTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
GTTGGGAAGGAGAGTAATTCTGACTACCGGGGTCAGGGAACCCTGGTCA
CCGTCTCGAGC

BMS2h-573 (SEQ ID NO: 749)
GAGGTGCAGCTGTTGGAGTCTGGGGGAGGCTTGGTACAGCCTGGGGGGT
CCCTGCGTCTCTCCTGTGCAGCCTCCGGATTCACCTTTAGTGGGTGGGA
GATGGGTTGGGTCCGCCAGGCTCCAGGGAAGGGTCTAGAGTGGGTCTCA
TCTATTGATGAGTCTGGTCTTAATACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
GGTGCCGCAGTATCAGATTACATTTGACTACTGGGGTCAGGGAACCC
TGGTCACCGTCTCGAGC

BMS2h-574 (SEQ ID NO: 750)
GAGGTGCAGCTGTTGGAGTCTGGGGGAGGCTTGGTACAGCCTGGGGGGT
CCCTGCGTCTCTCCTGTGCAGCCTCCGGATTCACCTTTCCTAATTATGG
GATGTATTGGGTCCGCCAGGCTCCAGGGAAGGGTCTAGAGTGGGTCTCA
TATATTTCGCGGAGGGGTTTGTTGACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
ACGTCGCATTATATGAATAATGGGTTTGACTACTGGGGTCAGGGAACCC
TGGTCACCGTCTCGAGC

BMS2h-575 (SEQ ID NO: 751)
GAGGTGCAGCTGTTGGAGTCTGGGGGAGGCTTGGTACAGCCTGGGGGGT
CCCTGCGTCTCTCCTGTGCAGCCTCCGGATTCACCTTTGTGGATTATAC
GATGGCTTGGGTCCGCCAGGCTCCAGGGAAGGGTCTGGAGTGGGTCTCA
TCTATTAGTCCGATTGGTACTTTTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
GATCCTTATGGGATGGAGGATGGTCTGACGTGGTTTGACTACTGGGGTC
AGGGAACCCTGGTCACCGTCTCGAGC

BMS2h-576 (SEQ ID NO: 752)
GAGGTGCAGCTGTTGGAGTCTGGGGGAGGCTTGGTACAGCCTGGGGGGT
CCCTGCGTCTCTCCTGTGCAGCCTCCGGATTCACCTTTGATGCGGTATGA
TATGCAGTGGGTCCGCCAGGCTCCAGGGAAGGGTCTGGAGTGGGTCTCA
ACGATTACGTCGGAGGGTCTTTCTACATACTACGCAGACTCCGTGAAGG
GCCGGTTCACCATCTCCCGCGACAATTCCAAGAACACGCTGTATCTGCA
AATGAACAGCCTGCGTGCCGAGGATACCGCGGTATATTACTGTGCGAAA
CCTAGTGATTTGTTTGACTACTGGGGTCAGGGAACCCTGGTCACCGTCT
CGAGC

BMS2h-577 (SEQ ID NO: 753)
GAGGTGCAGCTGTTGGAGTCTGGGGGAGGCTTGGTACAGCCTGGGGGGT
CCCTGCGTCTCTCCTGTGCAGCCTCCGGATTCACCTTTGATGGGTATGA
TATGGGTTGGGTCCGCCAGGCTCCAGGGAAGGGTCTAGAGTGGGTCTCA
ACTATTTCTGTGGGGGTTGGTTCACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
GGGACGAGTCAGTCGTCTACGGGGAGTTTTGACTACTGGGGTCAGGGAA
CCCTGGTCACCGTCTCG
AGC

BMS2h-578 (SEQ ID NO: 754)
GAGGTGCAGCTGTTGGAGTCTGGGGGAGGCTTGGTACAGCCTGGGGGGT
CCCTGCGTCTCTCCTGTGCAGCCTCCGGATTCACCTTTCGTCGGTATGA
TATGCTTTGGGCCGCCAGGCTCCAGGGAAGGGTCTAGAGTGGGTCTCA
GAGATTTCGCCTACGGGTGCTCTTACATACTACGCAGACTCCGTGAAGG
GCCGGTTCACCATCTCCCGCGACAATTCCAAGAACACGCTGTATCTGCA
AATGAACAGCCTGCGTGCCGAGGATACCGCGGTATATTACTGTGCGAAA
CTTGGTTCGACTTTTGACTACTGGGGTCAGGGAACCCTGGTCACCGTCT
CGAGC

BMS2h-579 (SEQ ID NO: 755)
GAGGTGCAGCTGTTGGAGTCTGGGGGAGGCTTGGTACAGCCTGGGGGGT
CCCTGCGTCTCTCCTGTGCAGCCTCCGGATTCACCTTTTTTCCGTATTA
TATGAGTTGGGTCCGCCAGGCTCCAGGGAAGGGTCTAGAGTGGGTCTCA
TCTATTTCGGGTACGGGTGGCTTACATACTACGCAGACTCCGTGAAGG
GCCGGTTCACCATCTCCCGCGACAATTCCAAGAACACGCTGTATCTGCA

TABLE 2-continued

Human Anti-CD40L VH Domain Encoding Nucleotide Sequences

AATGAACAGCCTGCGTGCCGAGGACACCGCGGTATATTACTGTGCGAAA
ACGACGCAGAATGCGACGCTTTTTGACTACTGGGGTCAGGGAACCCTGG
TCACCGTCTCGAGC

BMS2h-58 (SEQ ID NO: 756)
GAGGTGCAGCTGTTGGAGTCTGGGGGAGGCTTGGTACAGCCTGGGGGGT
CCCTGCGTCTCTCCTGTGCAGCCTCCGGATTCACCTTTGAGGTTTATAC
TATGGCGTGGGTCCGCCAGGCTCCAGGGAAGGGTCTGGAGTGGGTCTCA
ACGATTGATGAGTCTGGTCGTGATACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
CCTGGTGTTTGGTTTGACTACTGGGGTCAGGGAACCCTGGTCACCGTCT
CGAGC

BMS2h-580 (SEQ ID NO: 757)
GAGGTGCAGCTGTTGGAGTCTGGGGGAGGCTTGGTACAGCCTGGGGGGT
CCCTGCGTCTCTCCTGTGCAGCCTCCGGATTCACCTTTGCGTTTTATAA
GATGGGTGGGTCCGCCAGGCTCCAGGGAAGGGTCTAGAGTGGGTCTCA
ACGATTACTCCTAAGGGTCATCATACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
GTTTTTAAGGGTAAGGGTTGGACTCGTCCGAGTGGGTTTGACTACTGGG
GTCAGGGAACCCTGGTCACCGTCTCGAGC

BMS2h-581 (SEQ ID NO: 758)
GAGGTGCAGCTGTTGGAGTCTGGGGGAGGCTTGGTACAGCCTGGGGGGT
CCCTGCGTCTCTCCTGTGCAGCCTCCGGATTCACCTTTAATGAGTATAG
TATGATGTGGGTCCGCCAGGCTCCAGGGAAGGGTCTAGAGTGGGTCTCA
TCTATTGGGAGGCGTGGTTGGCTTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
GCTGTGCTGCTGGATTCTACTAAGTTTGACTACTGGGGTCAGGGAACCC
TGGTCACCGTCTCGAGC

BMS2h-582 (SEQ ID NO: 759)
GAGGTGCAGCTGTTGGAGTCTGGGGGAGGCTTGGTACAGCCTGGGGGGT
CCCTGCGTCTCTCCTGTGCAGCCTCCGGATTCACCTTTGATGAGTATCC
GATGACTTGGGTCCGCCAGGCTCCAGGGAAGGGTCTAGAGTGGGTCTCA
ACTATTTCTGCGCGTGGTCCTTTTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
GGTAGGCATTGGCTTCGTAATGGTCGTTTTGACTACTGGGGTCAGGGAA
CCCTGGTCACCGTCTCGAGC

BMS2h-583 (SEQ ID NO: 760)
GAGGTGCAGCTGTTGGAGTCTGGGGGAGGCTTGGTACAGCCTGGGGGGT
CCCTGCGTCTCTCCTGTGCAGCCTCCGGATTCACCTTTGGTATGCAGTC
GATGCAGTGGGTCCGCCAGGCTCCAGGGAAGGGTCTAGAGTGGGTCTCA
AGTATTACTGATGATGGTACTAGTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
CCTGATCGGGTTTTTGACTACTGGGGTCAGGGAACCCTGGTCACCGTCT
CGAGC

BMS2h-584 (SEQ ID NO: 761)
GAGGTGCAGCTGTTGGAGTCTGGGGGAGGCTTGGTACAGCCTGGGGGGT
CCCTGCGTCTCTCCTGTGCAGCCTCCGGATTCACCTTTGGGGCGGCTGA
TATGCAGTGGGTCCGCCAGGCTCCAGGGAAGGGTCTAGAGTGGGTCTCA
CTGATTACTAATGATGGTATTTCTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
GCGGGTGATCGTTTTGACTACTGGGGTCAGGGAACCCTGGTCACCGTCT
CGAGC

BMS2h-586 (SEQ ID NO: 762)
GAGGTGCAGCTGTTGGAGTCTGGGGGAGGCTTGGTACAGCCTGGGGGGT
CCCTGCGTCTCTCCTGTGCAGCCTCCGGATTCACCTTTAATAAGTATAG
GATGCAGTGGGTCCGCCAGGCTCCAGGGAAGGGTCTAGAGTGGGTCTCA
AGTATTGATAGTCTGGTGAGCTGACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
GAGGTTCCGATGGGGAATCAGACTTTTTTTGACTACTGGGGTCAGGGAA
CCCTGGTCACCGTCTCGAGC

BMS2h-587 (SEQ ID NO: 763)
GAGGTGCAGCTGTTGGAGTCTGGGGGAGGCTTGGTACAGCCTGGGGGGT
CCCTGCGTCTCTCCTGTGCAGCCTCCGGATTCACCTTTACTGATTATAC
TATGGGGTGGGTCCGCCAGGCTCCAGGGAAGGGTCTAGAGTGGGTCTCA
TCGATTACGTCTCAGGGTGCTTTTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
GCTACGGGTACGGATTCGTCGTTTGACTACTGGGGTCAGGGAACCCTGG
TCACCGTCTCGAGC

BMS2h-588 (SEQ ID NO: 764)
GAGGTGCAGCTGTTGGAGTCTGGGGGAGGCTTGGTACAGCCTGGGGGGT
CCCTGCGTCTCTCCTGTGCAGCCTCCGGATTCACCTTTGAGGATTATGA
GATGCTTGGGTCCGCCAGGCTCCAGGGAAGGGTCTGGAGTGGGTCTCA
TGTATTGGGCCGGGGGTAAGCCTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
GTGGATGGGCATTTTGACTACTGGGGTCAGGGAACCCTGGTCACCGTCT
CGAGC

BMS2h-589 (SEQ ID NO: 765)
GAGGTGCAGCTGTTGGAGTCTGGGGGAGGCTTGGTACAGCCTGGGGGGT
CCCTGCGTCTCTCCTGTGCAGCCTCCGGATTCACCTTTAGTCAGTATGA
TATGGGGTGGGTCCGCCAGGCTCCAGGGAAGGGTCTAGAGTGGGTCTCA
ACGATTTCTTGAGGGGTTGGCTTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
GGTCCGGGGGGTCGTCGGCGGTTTGACTACTGGGGTCAGGGAACCCTGG
TCACCGTCTCGAGC

BMS2h-59 (SEQ ID NO: 766)
GAGGTGCAGCTGTTGGAGTCTGGGGGAGGCTTGGTACAGCCTGGGGGGT
CCCTGCGTCTCTCCTGTGCAGCCTCCGGATTCACCTTTCTGGATTATGC
GATGGTTGGGTCCGCCAGGCTCCAGGGAAGGGTCTGGAGTGGGTCTCA
ACTATTTCCGATGGGTATGGGTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
TCGAGTGCTATTTCGTTTACTTCTGATATTTCTAATTTTGACTACTGGG
GTCAGGGAACCCTGGTCACCGTCTCGAGC

BMS2h-590 (SEQ ID NO: 767)
GAGGTGCAGCTGTTGGAGTCTGGGGGAGGCTTGGTACAGCCTGGGGGGT
CCCTGCGTCTCTCCTGTGCAGCCTCCGGATTCACCTTTAGTGATTATCC
GATGCTTGGGTCCGCCAGGCTCCAGGGAAGGGTCTAGAGTGGGTCTCA
AGTATTTCTTGGTCTGGTTTTCAGACATACTACGCAGACTCCGTGAAGG
GCCGGTTCACCATCTCCCGCGACAATTCCAAGAACACGCTGTATCTGCA
AATGAACAGCCTGCGTGCCGAGGATACCGCGGTATATTACTGTGCGAAA
CCTGGTGTTGCGAGGATGCCTACTGGGATTGCTTTTGACTACTGGGGTC
AGGGAACCCTGGTCACCGTCTCGAGC

BMS2h-591 (SEQ ID NO: 768)
GAGGTGCAGCTGTTGGAGTCTGGGGGAGGCTTGGTACAGCCTGGGGGGT
CCCTGCGTCTCTCCTGTGCAGCCTCCGGATTCACCTTTAGTGCTTATGA
GATGCAGTGGGTCCGCCAGGCTCCAGGGAAGGGTCTAGAGTGGGTCTCA
TCTATTGATGCTGGTATTTTACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTCTATTACTGTGCGGAA
CCTTTTGGGATGTTTGACTACTGGGGTCAGGGAACCCTGGTCACCGTCT
CGAGC

BMS2h-592 (SEQ ID NO: 769)
GAGGTGCAGCTGTTGGAGTCTGGGGGAGGCTTGGTACAGCCTGGGGGGT
CCCTGCGTCTCTCCTGTGCAGCCTCCGGATTCACCTTTTCGGAGTATCC
GATGAAGTGGGTCCGCCAGGCTCCAGGGAAGGGTCTAGAGTGGGTCTCA
ACGATTGATCGGCAGGGTGATCGGACATACTACGCAGACTCCGTGAAGG
GCCGGTTCACCATCTCCCGCGACAATTCCAAGAACACGCTGTATCTGCA
AATGAACAGCCTGCGTGCCGAGGACACCGCGGTATATTACTGTGCGAAA
ACGGTGCGGAGGGGTCTTCCTCGTCGAGTCGTTATTTTGACTACTGGG
GTCAGGGAACCCTGGTCACCGTCTCGAGC

BMS2h-593 (SEQ ID NO: 770)
GAGGTGCAGCTGTTGGAGTCTGGGGGAGGCTTGGTACAGCCTGGGGGGTC
CCTGCGTCTCTCCTGTGCAGCCTCCGGATTCACCTTTAGTGATTATGATA
TGGGTTGGGTCCGCCAGGCTCCAGGGAAGGGTCTGGAGTGGGTCTCAAGT
ATTTCGCCTGGTACATACTACGCAGACTCCGTGAAGGGCC
GTTCACCATCTCCCGCGACAATTCCAAGAACACGCTGTATCTGCAAATGA
ACAGCCTGCGTGCCGAGGACACCGCGGTATATTACTGTGCGAAAGGTCTG
AGTGTGTATTCGGGTCTTGATTTTGACTACTGGGGTCAGGGAACCCTGGT
CACCGTCTCGAGC

TABLE 2-continued

Human Anti-CD40L VH Domain Encoding Nucleotide Sequences

BMS2h-594 (SEQ ID NO: 771)
GAGGTGCAGCTGTTGGAGTCTGGGGGAGGCCTGGTACAGCCTGGGGGGTC
CCTGCGTCTCTCCTGCGCAGCCTCCGGATTCACCTTTTCTCATTATGATA
TGGGTTGGGTCCGCCAGGCTCCAGGGAAGGGTCTGGAGTGGGTCTCAGAT
ATTGATTATATTGGTAAGACTACATACTACGCAGACTCCGTGAAGGGCCG
GTTCACCATCTCTCGCGACAATTCCAAGAACACGCTGTATCTGCAAATGA
ACAGCCTGCGTGCCGAGGACACCGCGGTATATTACTGTGCGAAAGCTTCG
GATGAGGTGGGTGTTAATACTTCCAAGTTTGACTACTGGGGTCAGGGAAC
CCTGGTCACCGTCTCGAGC

BMS2h-595 (SEQ ID NO: 772)
GAGGTGCAGCTGTTGGAGTCTGGGGGAGGCTTGGTACAGCCTGGGGGGTC
CCTGCGTCTCTCCTGTGCAGCCTCCGGATTCACCTTTGCGCGGTATGATA
TGGGGTGGGTCCGCCAGGCTCCAGGGAAGGGTCTAGAGTGGGTCTCAACT
ATTTCTCCTACTGGTGTGTTGACATACATACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAAGGTTTT
GAGGATTTTGACTACTGGGGTCAGGGAACCCTGGTCACCGTCTCGAGC

BMS2h-596 (SEQ ID NO: 773)
GAGGTGCAGCTGTTGGAGTCTGGGGGAGGCTTGGTACAGCCTGGGGGGTC
CCTGCGTCTCTCCTGTGCAGCCTCCGGATTCACCTTTGAGGCTTATCCGA
TGAGTTGGGTCCGCCAGGCTCCAGGGAAGGGTCTAGAGTGGGTCTCACTG
ATTTCTCATACGGGTCATGCTACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAAGGGCAT
TGGCCTTTTGACTACCGGGTCAGGGAACCCTGATCACCGTCTCGAGC

BMS2h-597 0 (SEQ ID NO: 774)
GAGGTGCAGCTGTTGGAGTCTGGGGGAGGCTTGGTACAGCCAGGGGGGTC
CCTGCGCCTCTCCTGTGCAGCCTCCGGATTCACCTTTGAGGATGAGTGGA
TGAGTTGGGTCCGCCAGGCTCCAGGGAAGGGTCTAGAGTGGGTCTCAGAT
ATTAGCCCGGGTGGTTGGACTACATACTACGCCGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAAGGTTAT
CGTCCGTTTGATGAGTTTGACTACTGGGGTCAGGGAACCCTGGTCACCGT
CTCGAGC

BMS2h-598 (SEQ ID NO: 775)
GAGGTGCAGCTGTTGGAGTCTGGGGGAGGCTTGGTACAGCCTGGGGGGTC
CCTGCGTCTCTCCTGTGCAGCCTCCGAGTCACCTTTGATGCTATTGAGA
TGTCTTGGGTCCGCCAGGCTCCAGGGAAGGGTCTGGAGTGGGTCTCATCG
ATTTCGCGTCATGGTGAGTATACATACTACGCGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGGAAGATGCT
TGGTCTCGGCATTTTGACTACTGGGGTCAGGGAACCCTGGTCACCGTCTC
GAGC

BMS2h-599 (SEQ ID NO: 776)
GAGGTGCAGCTGTTGGAGTCTGGGGGAGGCTTGGTACAGCCTGGGGGGTC
CCTGCGTCTCTCCTGTGCAGCCTCCGGATTCACCTTTGATAGTACGGATA
TGAGTTGGGTCCGCCAGGCTCCAGGGAAGGGTCTAGAGTGGGTCTCAGGT
ATTTTGGATAATGGTAGTAATACATACTACGCAGACTCCGTGAAGGGCCG
GTTCACCATCTCCCGCGACAATTCCAAGAACATGCTGTATCTGCAAATGA
ATAGCCTGCGTGCCGAGGATACCGCGGTATATTACTGTGCGAAAGGGGCG
AGGGATTTTGACTACTGGGGTCAGGGAACCCTGGTCACCGTCTCGAGC

BMS2h-600 (SEQ ID NO: 777)
GAGGTGCAGCTGTTGGAGTCTGGGGGAGGCTTGGTACAGCCTGGGGGGTC
CCTGCGTCTCTCCTGTGCAGCCTCCGGATTCACCTTTGGTAGGCAGAGTA
TGCAGTGGGTCCGCCAGGCTCCAGGGAAGGGTCTAGAGTGGGTCTCAAGT
ATTGATGATGATGGTTTTCGACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAAGGGGAT
CCGTGGGGTTTTGACTACTGGGGTCAGGGAACCCTGGTCACCGTCTCGAG
C

BMS2h-601 (SEQ ID NO: 778)
GAGGTGCAGCTGTTGGAGTCTGGGGGAGGCTTGGTACAGCCTGGGGGGTC
CCTGCGTCTCTCCTGTACAGCCTCCGGATTCACCTTTAGTGATACGCAGA
TGGCGTGGGTCCGCCAGGCTCCAGGGAAGGGTCTAGAGTGGGTCTCAGGT
ATTGATGATGGGGTGAGTACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAACCGGAT
CGTCATTTTGACTACTGGGGTCAGGGAACCCTGGTCACCGTCTCGAGC

BMS2h-602 (SEQ ID NO: 779)
GAGGTGCAGCTGTTGGAGTCTGGGGGAGGCTTGGTACAGCCTGGGGGGTC
CCTGCGTCTCTCCTGTGCAGCCTCCGGATTCACCTTTGGGAGTACGACGA
TGGGTGGGTCCGCCAGGCTCCAGGGAAGGGTCTGGAGTGGGTCTCAGTG
ATTTTCGGATGATGGTGGTTTTACATACTACGCAGACTCCGTGAAGGGCCG
GTTCACCATCTCCCGCGACAATTCCAGGAACACGCTGTATCTGCAAATGA
ACAGCCTGCGTGCCGAGGACACCGCGGTATATTACTGTGCGAAAGTTGAT
GGTTATGGTGTTTTTGACTACTGGGGTCAGGGAACCCTGGTCACCGTCTC
GAGC

BMS2h-603 (SEQ ID NO: 780)
GAGGTGCAGCTGTTGGAGTCTGGGGGAGGCTTGGTACAGCCTGGGGGGTC
CCTGCGTCTCTCCTGTGCAGCCTCCGGATTCACCTTTCGGAGTGGGGATA
TGAATTGGGTCCGCCAGGCTCCAGGGAAGGGTCTAGAGTGGGTCTCAACT
ATTACGAATGATGGTACGTCTACATACTACGCAGACTCCGTGAAGGGCCG
GTTCACCATCTCCCGCGACAATTCCAAGAATACGCTGTATCTGCAAATGA
ACAGCCTGCGTGCCGAGGACACCGCGGTATATTACTGTGCGAAATCTGAT
TCTGATTTTGACTACTGGGGTCAGGGAACCCTGGTCACCGTCTCGAGC

BMS2h-61 (SEQ ID NO: 781)
GAGGTGCAGCTGTTGGAGTCTGGGGGAGGCTTGGTACAGCCTGGGGGGTC
CCTGCGTCTCTCCTGTGCAGCCTCCGGATTCACCTTTGCTGCTTATGCTA
TGACGTGGGTCCGCCAGGCTCCAGGGAAGGGTCTAGAGTGGGTCTCATAT
ATTAGTCCGAATGGTACGGCGACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGGAATATGTG
GGGATGCGTTGGAATTCTTTTGACTACTGGGGTCAGGGAACCCTGGTCAC
CGTCTCGAGC

BMS2h-62 (SEQ ID NO: 782)
GAGGTGCAGCTGTTGGAGTCTGGGGGAGGCTTGGTACAGCCTGGGGGGTC
CCTGCGTCTCTCCTGTGCAGCCTCCGGATTCACCTTTTCGAGTTATGAGA
TGGCTTGGGTCCGCCAGGCTCCAGGGAAGGGTCTAGAGTGGGTCTCATCT
ATTACGAGTCTTGGTACTTCTACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAACCGGGT
AGGAAGTTTGACTACTGGGGTCAGGGAACCCTGGTCACCGTCTCGAGC

BMS2h-65 (SEQ ID NO: 783)
GAGGTGCAGCTGTTGGAGTCTGGGGGAGGCTTGGTACAGCCTGGGGGGTC
CCTGCGTCTCTCCTGTGCAGCCTCCGGATTCACCTTTAATGAGTATGAGA
TGACGTGGGTCCGCCAGGCTCCAGGGAAGGGTCTAGAGTGGGTCTCAACG
ATTACTAGTGAGGGTAGTGGGACATACTACGCAGACTCCGTAAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAACCTAAT
GGTAAGTTTGACTACTGGGGTCAGGGAACCCTGGTCACCGTCTCGAGC

BMS2h-66 (SEQ ID NO: 784)
GAGGTGCAGCTGTTGGAGTCTGGGGGAGGCTTGGTACAGCCTGGGGGGTC
CCTGCGTCTCTCCTGTGCAGCCTCCGGATTCACCTTTTTCTGATTATGAGA
TGTTGTGGGTCCGCCAGGCTCCAGGGAAGGGTCTGGAGTGGGTCTCAACT
ATTACTAGTGAGGGTCATTCTACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAACCTGGG
ACTTCGTTTGACTACTGGGGTCAGGGAACCCTGGTCACCGTCTCGAGC

BMS2h-67 (SEQ ID NO: 785)
GAGGTGCAGCTGTTGGAGTCTGGGGGAGGCTTGGTACAGCCTGGGGGGTC
CCTGCGTCTCTCCTGTGCAGCCTCCGGATTCACCTTTAGTGATTATGAGA
TGAGTTGGGTCCGCCAGGCTCCAGGGAAGGGTCTAGAGTGGGTCTCAACG
ATTGATTCGATGGTAGTTTTACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAACCGGGT
GTGAAGTTTGACTACTGGGGTCAGGGAACCCTGGTCACCGTCTCGAGC

BMS2h-68 (SEQ ID NO: 786)
GAGGTGCAGCTGTTGGAGTCTGGGGGAGGCTTGGTACAGCCTGGGGGGTC
CCTGCGTCTCTCCTGTGCAGCCTCCGGATTCACCTTTAAGGATTATGAGA
TGACTTGGGTCCGCCAGGCTCCAGGGAAGGGTCTAGAGTGGGTCTCATCT
ATTTCTTCTACTGGTCAGTCTACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAACGGGT
AATAAGTTTGACTACTGGGGTCAGGGAACCCTGGTCACCGTCTCGAGC

BMS2h-69 (SEQ ID NO: 787)
GAGGTGCAGCTGTTGGAGTCTGGGGGAGGCTTGGTACAGCCTGGGGGGTC

TABLE 2-continued

Human Anti-CD40L VH Domain Encoding Nucleotide Sequences

CCTGCGTCTCTCCTGTGCAGCCTCCGGATTCACCTTTCTTGATTATGGTA
TGGCTTGGGTCCGCCAGGCTCCAGGGAAGGGTCTAGAGTGGGTCTCAGCT
ATTTCGCCTCTTGGTCTTAGTACATACTACGCAGACTCCGTGAAGAGCCG
GTTCACCATCTCCCGCGACAATTCCAAGAACACGCTGTATCTGCAAATGA
ACAGCCTGCGTGCCGAGGATACCGCGGTATATTACTGTGCGAAAGAGGTG
AGGGTGGGTAGGGGTGTTCATCCTCCGAAGTTTGACTACTGGGGTCAGGG
AACCCTGGTCACCGTCTCGAGC

BMS2h-7 (SEQ ID NO: 788)
GAGGTGCAGCTGTTGGAGTCTGGGGGAGGCTTGGTACAGCCTGGGGGGTC
CCTGCGTCTCTCCTGTGCAGCCTCCGGATTCACCTTTAATTTGTATGAGA
TGACTTGGGTCCGCCAGGCTCCAGGGAAGGGTCTAGAGTGGGTCTCATCT
ATTACTAGTGATGGTGTTTCTACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAAGCTGGG
GTGATTTTTGACTACTGGGGTCAGGGAACCCTGGTCACCGTCTCGAGC

BMS2h-70 (SEQ ID NO: 789)
GAGGTGCAGCTGTTGGAGTCTGGGGGAGGCTTGGTACAGCCTGGGGGGTC
CCTGCGTCTCTCCTGTGCAGCCTCCGGATTCACCTTTGAGAATTATGCTA
TGTCGTGGGTCCGCCAGGCTCCAGGGAAGGGTCTAGAGTGGGTCTCAACG
ATTGCTCCGCTGGGTGTTCCGACATACTACGCAGACTCCGTGAAGGGCCG
GTTCACCATCTCCCGCGACAATTCCAAGAACACGCTGTATCTGCAAATGA
ACAGCCTGCGTGCCGAGGATACCGCGGTATATTACTGTGCGAAAAAGAAG
GTTGGGGCGTGGCTGCAGTCGCGGAGTTTTGACTACTGGGGTCAGGGAAC
CCTGGTCACCGTCTCGAGC

BMS2h-701 (SEQ ID NO: 790)
GAGGTGCAGCTGTTGGAGTCTGGGGGAGGCTTGGTACAGCCTGGGGGGTC
CCTGCGTCTCTCCTGTGCAGCCTCCGGATTCACCTTTATGGATTATGATA
TGCATTGGGTCCGCCAGGCTCCAGGGAAGGGTCTAGAGTGGGTCTCAACG
ATTGGTGCTTCTGGTCATTATACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAATATCTT
GATATGCTGCTGTTTGGGTTTGACTACTGGGGTCAGGGAACCCTGGTCAC
CGTCTCGAGC

BMS2h-702 (SEQ ID NO: 791)
GAGGTGCAGCTGTTGGAGTCTGGGGGAGGCTTGGTACAGCCTGGGGGGTC
CCTGCGTCTCTCCTGTGCAGCCTCCGGATTCACCTTTGCTGAGTATGAGA
TGATGTGGGCCCGCCAGGCTCCAGGGAAGGGTCTAGAGTGGGTCTCACGT
ATTGCTGGTAATGGTTCTCGTACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGATAATGCTT
TCTCATTTTGACTACTGGGGTCAGGGAACCCTGGTCACCGTCTCGAGC

BMS2h-703 (SEQ ID NO: 792)
GAGGTGCAGCTGTTGGAGTCTGGGGGAGGCTTGGTACAGCCTGGGGGGTC
CCTGCGTCTCTCCTGTGCAGCCTCCGGATTCACCTTTTATAATTATGATA
TGAGTTGGGTCCGCCAGGCTCCAGGGAAGGGTCTAGAGTGGGTCTCAGGT
ATTGATTCGATGGGTCTTGTTACATACTACGCAGACTCCGTGAAGGGCCG
GTTCACCATCTCCCGCGACAATTCCAAGAACACGCTGTATCTGCAAATGA
ACAGCCTGCGTGCCGAGGATACCGCGGTATATTACTGTGCGAAAGGGTCT
AATGCGAGTGATTGGGTTGTTTTTGACTACTGGGGTCAGGGAACCCTGGT
CACCGTCTCGAGC

BMS2h-704 (SEQ ID NO: 793)
GAGGTGCAGCTGTTGGAGTCTGGGGGAGGCTTGGTACAGCCTGGGGGGTC
CCTGCGTCTCTCCTGTGCAGCCTCCGGATTCACCTTTGCGTCGTATCATA
TGACTTGGGTCCGCCAGGCTCCAGGGAAGGGTCTAGAGTGGGTCTCATCG
ATTGCGGATACGGGTGATCGTACATACTACGCAGACTCCGTGAAGGGCCG
GTTCACCATCTCCCGCGACAATTCCAAGAACACGCTGTATCTGCAAATGA
ACAGCCTGCGTGCCGAGGACACTGCGGTATATTACTGTGCGAATTGCGT
GGGATGGCTCGGGTTTGGGGGTTTGACTACTGGGGTCAGGGAACCCTGGT
CACCGTCTCGAGC

BMS2h-705 (SEQ ID NO: 794)
GAGGTGCAGCTGTTGGAGTCTGGGGGAGGCTTGGTACAGCCTGGGGGGTC
CCTGCGTCTCTCCTGTGCAGCCTCCGGATTCACCTTTAGTTATTATGATA
TGATGTGGGTCCGCCAGGCTCCAGGGAAGGGTCTAGAGTGGATCTCATCT
ATTTCGGATCGTGGTCTTCAGACATACTACGCAGACTCCGTGAAGGGCCG
GTTCACCATCTCCCGCGACAATTCCAAGAACACGCTGTATCTGCAAATGA
ACAGCCTGCGTGCCGAGGATACCGCGGTATATTACTGTGCGAAATTTACG
GAGATTCCGTTGGATTGTTGGAGGTGTTTGACTACTGGGGTCAGGGAAC
CCTGGTCACCGTCTCGAGC

BMS2h-706 (SEQ ID NO: 795)
GAGGTGCAGCTGTTGGAGTCTGGGGGAGGCTTGGTACAGCCTGGGGGGTC
CCTGCGTCTCTCCTGTGCAGCCTCCGGATTCACCTTTGGGAGTTATAAGA
TGTTGTGGGTCCGCCAGGCTCCAGGGAAGGGTCTAGAGTGGGTCTCATCG
ATTACTAATTCTGGTACTGAGACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAATCGATG
TATCCGGATTTGGAGATTGTGCATTTTGACTACTGGGGTCAGGGAACCCT
GGTCACCGTCTCGAGC

BMS2h-707 (SEQ ID NO: 796)
GAGGTGCAGCTGTTGGAGTCTGGGGGAGGCTTGGTACAGCCTGGGGGGTC
CCTGCGTCTCTCCTGTGCAGCCTCCGGATTCACCTTTGAGACTTATCGTA
TGAGTTGGGTCCGCCAGGCTCCAGGGAAGGGTCTAGAGTGGGTCTCAGCT
ATTGATCAGGAGGTTCTGCTACATACTACGCAGACTCCGTGAAGGGCCG
GTTCACCATCTCCCGCGACAATTCCAAGAACACGCTGTATCTGCAAATGA
ACAGCCTGCGTGCCGAGGATACCGCGGTATATTACTGTGCGAAAAATAGT
GGGACGAGGCCGGGGCTTCGGTTTGACTACTGGGGTCAGGGAACCCTGGT
CACCGTCTCGAGC

BMS2h-708 (SEQ ID NO: 797)
GAGGTGCAGCTGTTGGAGTCTGGGGGAGGCTTGGTACAGCCTGGGGGGTC
CCTGCGCCTCTCCTGTGCAGCCTCCGGATTCACCTTTAGTAGTTATGATA
TGCTTTGGGTCCGCCAGGCTCCAGGGAAGGGTCTAGAGTGGGTCTCACGG
ATTGATGCTGGTTATTTTACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGCAATTGTTG
AAGCTGTCGTTGAATCCTAATTTTGACTACTGGGGTCAGGGAACCCTGGT
CACCGTCTCGAGC

BMS2h-709 1 (SEQ ID NO: 798)
GAGGTGCAGCTGTTGGAGTCTGGGGGAGGCTTGGTACAGCCTGGGGGGTC
CCTGCGTCTCTCCTGTGCAGCCTCCGGATTCACCTTTAGCAGCTATGCCA
TGAGCTGGGTCCGCCAGGCTCCAGGGAAGGGTCTAGAGTGGGTCTCATCG
ATTCATAATACTGGTTTGTCTACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAAGGGACT
CAGCATCGTTTTGTTGTTTTTGACTACTGGGGTCAGGGAACCCTGGTCAC
CGTCTCGAGC

BMS2h-71 (SEQ ID NO: 799)
GAGGTGCAGCTGTTGGAGTCTGGGGGAGGCTTGGTACAGCCTGGGGGGTC
CCTGCGTCTCTCCTGTGCAGCCTCCGGATTCACCTTTGAGGGTTATCCTA
TGTCGTGGGTCCGCCAGGCTCCAGGGAAGGGTCTAGAGTGGGTCTCAACT
ATTAGTCCTTTGGGTCCTGATACATACTACGCAGACTCCGTGAAGGGCCG
GTTCACCATCTCCCGCGACAATTCCAAGAACACGCTGTATCTGCAAATGA
ACAGCCTGCGTGCCGAGGATACCGCGGTATATTACTGTGCGAAACTGTTG
ATGGGGAGTATTTGAATTCTAGGACGTTTGACTACTGGGGTCAGGGAAC
CCTGGTCACCGTCTCGAGC

BMS2h-710 (SEQ ID NO: 800)
GAGGTGCAGCTGTTGGAGTCTGGGGGAGGCTTGGTACAGCCTGGGGGGTC
CCTGCGTCTCTCCTGTGCAGCCTCCGGATTCACCTTTAATACGTATAGTA
TGTCTTGGGTCCGCCAGGCTCCAGGGAAGGGTCTGGAGTGGGTCTCATGG
ATTGATGCTGATGGTTGGGTTACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGCAAACTGGG
CATACGTTTGACTACTGGGGTCAGGGAACCCTGGTCACCGTCTCGAGC

BMS2h-711 (SEQ ID NO: 801)
GAGGTGCAGCTGTTGGAGTCTGGGGGAGGCTTGGTACAGCCTGGGGGGTC
CCTGCGTCTCTCCTGTGCAGCCTCCGGATTCACCTTTACGGATGGGGAGA
TGGGTTGGGCCCGCCAGGCTCCAGGGAAGGGTCTAGAGTGGGTCTCAAGG
ATTGTGGATCCTGGTGATTCTACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAAGCGGGT
GATCAGTTTGACTACTGGGGTCAGGGAACCCTGGTCACCGTCTCGAGC

BMS2h-712 (SEQ ID NO: 802)
GAGGTGCAGCTGTTGGAGTCTGGGGGAGGCTTGGTACAGCCTGGGGGGTC
CCTGCGTCTCTCCTGTGCAGCCTCCGGATTCACCTTTCTGAGTATGAGA
TGAAGTGGGTCCGCCAGGCTCCAGGGAAGGGTCTAGAGTGGGTCTCAACT
ATTACTCCGTGGGTGGTCATACATACTACGCAGACTCCGTGAAGGGCCG
GTTCACCATCTCCCGCGACAATTCCAAGAACACGCTGTATCTGCAAATGA
ACAGCCTGCGTGCCGAGGACGCCGCGGTATATTACTGTGCGATACCTCTT
TCTAGTTTTGACTACTGGGGTCGGGGAACCCTGGTCACCGTCTCGAGC

TABLE 2-continued

Human Anti-CD40L VH Domain Encoding Nucleotide Sequences

BMS2h-713 (SEQ ID NO: 803)
GAGGTGCAGCTGTTGGAGTCTGGGGGAGGCTTGGTACAGCCTGGGGGGTC
CCTGCGTCTCTCCTGTGCAGCCTCCGGATTCACCTTTTCTAATTATGTGA
TGATTTGGGTCCGCCAGGCTCCAGGGAAGGGTCTAGAGTGGGTCTCACTT
ATTAATGGTGCTGGTGATATGACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGGAAGGGGGT
GCGCGTTCGTTTGGGGTTCCGCCTAATTTTGACTACTGGGGTCAGGGAAC
CCTGGTCACCGTCTCGAGC

BMS2h-714 (SEQ ID NO: 804)
GAGGTGCAGCTGTTGGAGTCTGGGGGAGGCTTGGTACAGCCTGGGGGGTC
CCTGCGTCTCTCCTGTGCAGCCTCCGGATTCACCTTTCACGGATGGGGAGA
TGGGTTGGGCCCGCCAGGCTCCAGGGAAGGGTCTAGAGTGGGTCTCAAGG
ATTGTGGATCCTGGTGATTACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAAGCGGGT
GATCAGTTTGACTACTGGGGTCAGGGAACCCTGGTCACCGTCTCGAGC

BMS2h-715 (SEQ ID NO: 805)
GAGGTGCAGCTGTTGGAGTCTGGGGGAGGCTTGGTACAGCCTGGGGGGTC
CCTGCGTCTCTCCTGTGTAGCCTCCGGATTCACCTTTACGCTGTATAATA
TGTCTTGGGTCCGCCAGGCTCCAGGGAAGGGTCTGGAGTGGGTCTCAGTT
ATTTCTAGTAAGGGTGATAGTACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGCAAACGAGT
AGTGTTTTTGACTACTGGGGTCAGGGAACCCTGGTCACCGTCTCGAGC

BMS2h-716 (SEQ ID NO: 806)
GAGGTGCAGCTGTTGGAGTCTGGGGGAGGCTTGGTACAGCCTGGGGGGTC
CCTGCGTCTCTCCTGTGCAGCCTCCGGATTCACCTTTGAGGCGTATTATA
TGAGTTGGGTCCGCCAGGCTCCAGGGAAGGGTCTAGAGTGGGTCTCAGGT
ATTGTTAATAATGGTTTGTTGACATACTACGCAGACTCCGTGAAGGGCCG
GTTCACCATCTCCCGCGACAATTCCAAGAACATGCTGTATCTGCAAATGA
ACAGCCTGCGTGCCGAGGACACCGCGGTATATTACTGTGCGAAATCGGCT
GTTCATCCTTCGTATAGGGCGGAGTTGTTCGACTACTGGGGTCAGGGAAC
CCTGGTCACCGTCTCGAGC

BMS2h-717 (SEQ ID NO: 807)
GAGGTGCAGCTGTTGGAGTCTGGGGGAGGCTTGGTACAGCCTGGGGGGTC
CCTGCGTCTCTCCTGTGCAGCCTCCGGATTCACCTTTAGTTCGTATGAGA
TGGCGTGGGTCCGCCAGGCTCCAGGGAAGGGTCTAGAGTGGGTCTCAGGT
ATTGAGCGTGATGGTAGTAATACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAAGGTCCG
GATAATTTTACTATGTTTGACTACTGGGGTCAGGGAACCCTGGTCACCGT
CTCGAGC

BMS2h-718 (SEQ ID NO: 808)
GAGGTGCAGCTGTTGGAGTCTGGGGGAGGCTTGGTACAGCCTGGGGGGTC
CCTGCGTCTCTCCTGTGCAGCCTCCGGATTCACCTTTAATAAGTATATGA
TGGGGTGGGTCCGCCAGGCTCCAGGGAAGGGTCTAGAGTGGGTCTCATCT
ATTGATAGTCTTGGTCATTATACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAGCGGAG
TTTCCGTTTGACTACTGGGGTCAGGGAACCCTGGTCACCGTCTCGAGC

BMS2h-719 (SEQ ID NO: 809)
GAGGTGCAGCTGTTGGAGTCTGGGGGAGGCTTGGTACAGCCTGGGGGGTC
CCTGCGTCTCTCCTGTGCAGCCTCCGGATTCACCTTTAAGAGGTATGAGA
TGACGTGGGTCCGCCAGGCTCCAGGGAAGGGTCTGGAGTGGGTCTCATCT
ATTTCGTCGGATGGTTCTTTTACATACTACGCAGACTCCGTGAAGGGCCG
GTTCACCATCTCCCGCGACAATTCCAAGAACACGCTGTATCTGCAAATGA
ACAGCCTGCGTGCCGAGGATACCGCGGTATATTACTGTGCGGAACCGTTT
ACTGAGTTTGACTACTGGGGTCAGGGAACCCTGGTCACCGTCTCGAGC

BMS2h-719-1 (SEQ ID NO: 810)
GAGGTGCAGCTGTTGGAGTCTGGGGGAGGCATGGTACAGCCTGGGGGGTC
CCTGCGTCTCTCCTGTGCAGCCTCCGGATTCACCTTTAAGAGGTATGAGA
TGATGTGGGTCCGCCAGGCTCCAGGGAAGGGTCTGGAGTGGGTCTCATCT
ATTTCGTCGGATGGTTCTTTTACATACTACGCAGACTCCGTGAAGGGCCG
GTTCACCATCTCCCGCGACAATTCCAAGAACACGCTGTATCTGCAAATGA
ACAGCCTGCGTGCCGAGGATACCGCGGTATATTACTGTGCGGAACCGTTT
ACTGAGTTTGACTACTGGGGTCAGGGAACCCAGGTCACCGTCTCGAGC

BMS2h-719-10 (SEQ ID NO: 811)
GAGGTGCAGCTGTTGGAGTCTGGGGGAGGCATGGTGCAGCCTGGGGGGTC
CCTGCGTCTCTCCTGTGCAGCCTCCGGATTCACCTTTAAGAGGTATGAGA
TGATGTGGGTCCGCCAGGCTCCAGGGAAGGGTCTGGAGTGGGTCTCATCT
ATTTCGTCGGATGGTTCTTTTACATACTACGCAGACTCCGTGAAGGGCCG
GTTCACCATCTCCCGCGACAATTCCAAGAACACGCTGTATCTGCAAATGA
ACAGCCTGCGTGCCGAGGATACCGCGGTATATTACTGTGCGAACCGTTT
ACTGAGTTTGACTACTGGGGTCAGGGAACCCTGGTCACCGTCTCGAGC

BMS2h-719-11 (SEQ ID NO: 812)
GAGGTGCAGCTGTTGGAGTCTGGGGGAGGCTTGGTACAGCCTGGGGGGTC
CCTGCGTCTCTCCTGTGCAGCCTCCGGATTCACCTTTAAGAGGTATGAGA
TGATGTGGGTCCGCCAGGCTCCAGGGAAGGGTCTGGAGTGGGTCTCATCT
ATTTCGTCGGATGGTTCTTTTACATACTACGCAGACTCCGTGAAGGGCCG
GTTCACCATCTCCCGCGACAATTCCAAGAACACGCTGTATCTGCAAATGA
ACAGCCTGCGTGCCGAGGATACCGCGGTATATTACTGTGCGGATCCGTTT
ACTGAGTTTGACTATTGGGTCAGGGTACCCTGGTCACCGTCTCGAGC

BMS2h-719-12 (SEQ ID NO: 813)
GAGGTGCAGCTGTTGGAGTCTGGGGGAGGCTTGGTACAGCCTGGGGGGTC
CCTGCGTCTCTCCTGTGCAGCCTCCGGATTCACCTTTAAGAGGTATGAGA
TGATGTGGGTCCGCCAGGCTCCAGGGAAGGGTCTGGAGTGGGTCTCATCT
ATTTCGTCGGATGGTTCTTTTACATACTACGCAGACTCCGTGAAGGGCCG
GTTCACCGTCTCCCGCGACAATTCCAAGAACACGCTGTATCTGCAAATGA
ACAGCCTGCGTGCCGAGGATACCGCGGTATATTACTGTGCGGACCCGTTT
ACTGAGTTTGACTACTGGGGTCAGGGAACCCTGGTCACCGTCTCGAGC

BMS2h-719-13 (SEQ ID NO: 814)
GAGGTGCAGCTGTTGGAGTCGGGGGGAGGCTTGGTACAGCCTGGGGGGTC
CCTGCGTCTCTCGTGTGCAGCCTCCGGATTCACCTTTAAGAGGTATGAGA
TGATGTGGGTCCGCCAGGCTCCAGGGAAGGGTCTGGAGTGGGTCTCATCT
ATTTCGTCGGATGGTTCTTTTACATACTACGCAGACTCCGTGAAGGGCCG
GTTCACCATCTCCCGCGACAATACCAAGAACACGCTGTATCTACAGATGA
ACAGCCTGCGTGCCGAGGATACCGCGGTATATTACTGTGCGGACCCGTTT
ACTGAGTTTGACTACTGGGGTCATGGAACCCTGGTCACCGTCTCGAGC

BMS2h-719-14 (SEQ ID NO: 815)
GAGGTGCAGCTGTTGGAGTCTGGGGGAGGCTTGGTACAGCCTGGGGGGTC
CCTGCGTCTCTCCTGTGCAGCCTCCGGATTCACCTTTAAGAGGTATGAGA
TGATGTGGGTCCGCCAGGCTCCAGGGAAGGGTCTGGAGTGGGTCTCATCT
ATTTCGTCGGATGGTTCTTTTACATACTACGCAGACTCCGTGAAGGGCCG
GTTCACCATCTCCCGCGACAATTCCAAGAACACGCTGTATCTGCAAATGA
ACAGCCTGCGTGCCGAGGATACCGCGGTATATTTCTGTGCAGATCCGTTT
ACTGAGTTTGACTACTGGGGTCAGGGAACCCTGGTCACCGTCTCGAGC

BMS2h-719-15 (SEQ ID NO: 816)
GAGGTGCAGCTGTTGGAGTCTGGGGGAGGCTTGGTACAGCCTGGGGGGTC
CCTGCGTCTCTCCTGTGCAGCCTCCGGATTCGCCTTTAAGAGGTATGAGA
TGACATGGGTCCGCCAGGCTCCAGGGAAGGGTCTGGAGTGGGTCTCATCT
ATTTCGTCGGATGGTTCTTTTACATACTACGCAGACTCCGTGAAGGGCCG
GTTCACCATCTCCCGCGACAATTCCAAGAACACGCTGTATCTGCATATGA
ACAGCCTGCGTGCCGAGGATACCGCGGTATATTACTGTGCGGATCCGTTT
ACTGAGATTGACTACTGGGGTCAGGGAACCCTGGTCACCGTCTCGAGC

BMS2h-719-16 (SEQ ID NO: 817)
GAGGTGCAGCTGTTGGAGTCTGGGGGAGGCTTGGTACAGCCTGGGGGGTC
CCTGCGTCTCTCCTGTGCAGCCTCCGGATTCCCCTTTAAGAGGTATGAGA
TGACGTGGGTCCGCCAGGCTCCAGGGAAGGGTCTGGAGTGGGTCTCATCT
ATTTCGTCGGATGGTTCTTTTACATACTACGCAGACTCCGTGAAGGGCCG
GTTCACCATCTCCCGCGACAATTCCAAGAACACGCTGTATCTGCAAATGA
ACAGCCTGCGTGCCGAGGATACCGCGGTATATTACTGTGCGGAACCGTTT
ACTGAGTTTGACTACCGGGCTCAGGGAACCCTGGTCACCGTCTCGAGC

BMS2h-719-17 (SEQ ID NO: 818)
GAGGTGCAGCTGTTGGAGTCTGGGGGAGGCTTGGTACAGCCTGGGGGGTC
CCTGCGTCTCTCCTGTGCAGCCTCCGGATTCACCTTTAAGAGGTATGAGA
TGTCGTGGGTCCGCCAGGCTCCAGGGAAGGGTCTGGAGTGGGTCTCTTCT
ATTTCGTCGGATGGTTCTTTTACATACTACGCAGACTCCGTGAAGGGCCG
GTTCACCATCTCCCGCGACAATTCCAAGAACACGCTGTATCTGCAAATGA
ACAGCCTGCGTGCCGAGGATACCGCGGTATATTACTGTGCGGATCCGTTT
ACTGAGATTGACTACTGGGGTCAGGGAACCCAGGTCACCGTCTCGAGC

BMS2h-719-18 (SEQ ID NO: 819)
GAGGTGCAGCTGTTGGAGTCTGGGGGAGGCTTGGTACATCCTGGGGGGTC
CCTGCGTCTCTCCTGTGCAGCTTCCGGATTCACCTTTAAGAGGTATGAGA
TGTGTGGGTCCGCCAGGCTCCAGGGAAGGGTCTGGAGTGGGTCTCATCT

TABLE 2-continued

Human Anti-CD40L VH Domain Encoding Nucleotide Sequences

ATTTCGTCGGATGGTTCTTTTACATACTACGCAGACTCCGTGAAGGGCCG
GTTCACCATCTCCCGCGACAATTCCAAGAACACGCTGTATCTGCAAATGA
ACAGCCTGCGTGACGAGGATACCGCGGTATATTACTGTGCGGAACCGTTT
ACTGAGTTTGACTACGGGGGTCAGGGAACCCTGGTCACCGTCTCGAGC

BMS2h-719-19 (SEQ ID NO: 820)
GAGGTGCAGCTGTTGGAGTCTGGGGGAGGCTGGGTACAGCCTGGGGGGTC
CCTGCGTCTCTCCTGTGCAGCCTCAGGATTCACCTTTAAGAGGTATGAGA
TGATGTGGGTCCGCCAGGCTCCAGGGAAGGGTCTGGAGTGGGTCTCATCT
ATTTCGTCGGATGGTTCTTTTACATACTACGCAGACTCCGTGAAGGGCCG
GTTCACCATCTCCCGCGACAATTCCAAGAACACGCTGTATCTGCAAATGA
ACAGCCTGCGTGCCGAGGATACCGCGGTATATTACTGTGCGGATCCGTTT
ACTGAGTTTGACTACTGGGGTCAGGGAACCCTGGTCACCGTCTCGAGC

BMS2h-719-2 (SEQ ID NO: 821)
GAGGTGCAGCTGTTGGAGTCTGGGGGAGGCTTGGTACAGCCTGGGGGGTC
CCTGCGTCTCTCCTGTGCAGCCTCCGGATTCACCTTTAAGAGGTATGAGA
TGATGTGGGTCCGCCAGGCTCCAGGGAAGGGTCTGGAGTGGGTCTCATCT
ATTTCGTCGGATGGTTCTTTTACATACTACGCAGACTCCGTGAAGGGCCG
GTTCACCATCTCCCGCGACAATTCCAAGAACACGCTGTATCTGCAAATGA
ACAGCCTGCGTGCCGAGGATACCGCGGTATATTACTGTGCGGAACCGTTT
ACTGAGTTTGACTACTGGGGTCATGGAACCCTGGTCACCGTCTCGAGC

BMS2h-719-20 (SEQ ID NO: 822)
GAGGTGCAGCTGTTGGAGTCTGGGGGAGGCTTGGTACAGCCTGGGGGGTC
CCTGCGTCTCTCCTGTGCAGCCTCCGGATTCACCTTTAAGAGGTATGAGA
TGACGTGGGTCCGCCAGGCTCCAGGGAAGGGTCTGGAGTGGGTCTCATCT
ATTTCGTCGGATGGTTCTTTTACATACTACGCAGACTCCGTGAAGGGCCG
GTTCACCATCTCCCGCGACAATTCCAAGAACACTCTGTATCTGCAAATGA
ACAGCCTGCGTGCCGAGGATACCGCGGTATATTACTGTGCGGAACCGTTT
ACTGAGATTGACTACCGGGGTCAGGGAACCCTGGTCACCGTCTCGAGC

BMS2h-719-202 (SEQ ID NO: 823)
GAGGTGCAGCTGTTGGAGTCTGGGGGAGGCTTGGTACAGCCTGGGGGGTC
CCTGCGTCTCTCCTGTGCAGCCTCCGGATTCACCTTTAAGAAGTATGAGA
TGATGTGGGTCCGCCAGGCTCCAGGGAAGGGTCTGGAGTGGGTCTCATCT
ATTTCGTCGGATGGTTCTTTTACATACTACGCAGACTCCGTGAAGGGCCG
GTTCACCATCTCCCGCGACAATTCCAAGAACACGCTGTATCTGCAAATGA
ACAGCCTGCGTGCCGAGGATACCGCGGTATATTACTGTGCGGAACCGTTT
ACTGAGTTTGACTACTGGGGTCATGGAACCCTGGTCACCGTCTCGAGC

BMS2h-719-203 (SEQ ID NO: 824)
GAGGTGCAGCTGTTGGAGTCTGGGGGAGGCTTGGTACAGCCTGGGGGGTC
CCTGCGTCTCTCCTGTGCAGCCTCCGGATTCACCTTTAACAGCTATGAGA
TGATGTGGGTCCGCCAGGCTCCAGGGAAGGGTCTAGAGTGGGTCTCATCT
ATTTCGTCGGATGGTTCTTTTACATACTACGCAGACTCCGTGAAGGGCCG
GTTCACCATCTCCCGCGACAATTCCAAGAACACGCTGTATCTGCAAATGA
ACAGCCTGCGTGCCGAGGATACCGCGGTATATTACTGTGCGGAACCGTTT
ACTGAGTTTGACTACTGGGGTCATGGAACCCTGGTCACCGTCTCGAGC

BMS2h-719-21 (SEQ ID NO: 825)
GAGGTGCAGCTGTTGGAGTCTGGGGGAGGCTTGGTACAGCCTGGGGGGTC
CCTGCGTCTCTCCTGTGCAGCCTCCGGATTCACCTTTAAGAGGTATGAGA
TGATGTGGGTCCGCCAGGCTCCAGGGAAGGGTCTGGAGTGGGTCTCATCT
ATTTCGTCGGATGGTTCTTTTACATACTACGCAGACTCCGTGAAGGGCCG
GTTCACCATCTCCCGCGACAATTCCAAGAACACGCTGTATCTGCAAATGA
ACAGCCTGCGTGCCGAGGATACCGCGGTATATTACTGTGCGGATCCATTT
ACTGAGTTTGACTACTGGGGTCAGGGAACCCTGGTCACCGTCTCGAGC

BMS2h-719-213 (SEQ ID NO: 826)
GAGGTGCAGCTGTTGGAGTCTGGGGGAGGCTTGGTACAGCCTGGGGGGTC
CCTGCGTCTCTCCTGTGCAGCCTCCGGATTCACCTTTAAGAGGTATGAGA
TGATGTGGGTCCGCCAGGCTCCAGGGAAGGGTCTGGAGTGGGTCTCATCT
ATTTCGTCGGATGGTTCTTTTACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGTATATTACTGTGCGGACCCGTTC
ACGGAGATGGACTACTGGGGTCATGGAACCCTGGTCACCGTCTCGAGC

BMS2h-719-214 (SEQ ID NO: 827)
GAGGTGCAGCTGTTGGAGTCTGGGGGAGGCTTGGTACAGCCTGGGGGGTC
CCTGCGTCTCTCCTGTGCAGCCTCCGGATTCACCTTTAAGAGGTATGAGA
TGATGTGGGTCCGCCAGGCTCCAGGGAAGGGTCTGGAGTGGGTCTCATCT
ATTTCGTCGGATGGTTCTTTTACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGGACCCGTTC
ACGGAGTTCGACTACTGGGGTCATGGAACCCTGGTCACCGTCTCGAGC

BMS2h-719-215 (SEQ ID NO: 828)
GAGGTGCAGCTGTTGGAGTCTGGGGGAGGCTTGGTACAGCCTGGGGGGTC
CCTGCGTCTATCCTGTGCAGCCTCCGGATTCACCTTTAAGAGGTATGAGA
TGATGTGGGTCCGCCAGGCTCCAGGGAAGGGTCTGGAGTGGGTCTCATCT
ATTTCGTCGGATGGTTCTTTTACATACTACGCAGACTCCGTGAAGGGCCG
GTTCACCATCTCCCGCGACAATTCCAAGAACACGCTGTATCTGCAAATGA
ACAGCCTGCGTGCCGAGGATACCGCGGTATATTACTGTGCGGAGCCGTTC
ACGGAGTTGGACTACTGGGGTCATGGAACCCTGGTCACCGTCTCGAGC

BMS2h-719-218 (SEQ ID NO: 829)
GAGGTGCAGCTGTTGGAGTCTGGGGGAGGCTTGGTACAGCCTGGGGGGTC
CCTGCGTCTCTCCTGTGCAGCCTCCGGATTCACCTTTAAGAGGTATGAGA
TGATGTGGGTCCGCCAGGCCCCAGGGAAGGGTCTGGAGTGGGTCTCATCG
ATTTCCGACGGTTCCTTCACGTACTACGCGAGTCGGTCAAGGGCCG
GTTCACCATCTCCCGCGACAATTCCAAGAACACGCTGTATCTGCAAATGA
ACAGCCTGCGTGCCGAGGATACCGCGGTATATTACTGTGCGGAACCGTTT
ACTGAGTTTGACTACTGGGGTCATGGAACCCTGGTCACCGTCTCGAGC

BMS2h-719-225 (SEQ ID NO: 830)
GAGGTGCAGCTGTTGGAGTCTGGGGGAGGCTTGGTACAGCCTGGGGGGTC
CCTGCGTCTCTCCTGTGCAGCCTCCGGATTCACCTTTAACACGTATGAGA
TGCAGTGGGTCCGCCAGGCTCCAGGGAAGGGTCTGGAGTGGGTCTCATCT
ATTTCGTCGGATGGTTCTTTTACATACTACGCAGACTCCGTGAAGGGCCG
GTTCACCATCTCCCGCGACAATTCCAAGAACACGCTGTATCTGCAAATGA
ACAGCCTGCGTGCCGAGGATACCGCGGTATATTACTGTGCGGAACCGTTT
ACTGAGTTTGACTACTGGGGTCATGGAACCCTGGTCACCGTCTCGAGC

BMS2h-719-226 (SEQ ID NO: 831)
GAGGTGCAGCTGTTGGAGTCTGGGGGAGGCTTGGTACAGCCTGGGGGGTC
CCTGCGTCTCTCCTGTGCAGCCTCCGGATTCACCTTTAACAAGTATGAGA
TGATGTGGGTCCGCCAGGCTCCAGGGAAGGGTCTGGAGTGGGTCTCATCT
ATTTCGTCGGATGGTTCTTTTACATACTACGCAGACTCCGTGAAGGGCCG
GTTCACCATCTCCCGCGACAATTCCAGGAACACGCTGTATCTGCAAATGA
ACAGCCTGCGTGCCGAGGATACCGCGGTATATTACTGTGCGGAACCGTTT
ACTGAGTTTGACTACTGGGGTCATGGAACCCTGGTCACCGTCTCGAGC

BMS2h-719-3 (SEQ ID NO: 832)
GAGGTGCAGCTGTCGGAGTCTGGGGGAGGCTTGGTACAGCCTGGGGGGTC
CCTGCGTCTCTCCTGTGCAGCCTCCGGATTCACCTTTAAGAGGTATGAGA
TGATGTGGGTCCGCCAGGCTCCAGGGAAGGGTCTGGAGTGGGTCTCATCT
ATTTCGTCGGATGGTTCTTTTACATACTACGCAGACTCCGTGAAGGGCCG
GTTCACCATCTCCCGCGACAATTCCAAGAATACGCTGTATCTGCAAATGA
ACAGCCTGCGTGCCGAGGATACCGCGGTATATTACTGTGCGGATCCGTTT
ACTGAGTTTGACTACTGGGGTCAGGGAACCCTGGTCACCGTCTCGAGC

BMS2h-719-4 (SEQ ID NO: 833)
GAGGTGCAGCTGTTGGAGTCTGGGGGAGGCTTGGTACAGCCTGGGGGGTC
CCTGCGTCTCTCCTGTGCAGCCTCCGGATTCACCTTTAAGAGGTATGAGA
TGATGTGGGTCCGCCAGACTCCAGGGAAGGGTCTGGAGTGGGTCTCATCT
ATTTCGTCGGATGGTTCTTTTACATACTACGCAGACTCCGTGAAGGGCCG
GTTCACCATCTCCCGCGACAATTCCAAGAACACGCTGTATCTGCAAATGA
ACAGCCTGCGTGCCGAGGATACCGCAGTATATTACTGTGCGGAACCGTTT
ACTGAGTTTGACTACTGGGGTCAGGGAACCCTGGTCACCGTCTCAAGC

BMS2h-719-5 (SEQ ID NO: 834)
GAGGTGCAGCTGTTGGAGTCTGGGGGAGGCTTGGTACAGCCTGGGGGGTC
CCTGCGTCTCTCCTGTGCAGCCTCCGGATTCACCTTTAAGAGGTATGAGA
TGATGTGGGTCCGCCAGGCTCCAGGGAAGGGTCTGGAGTGGGTCTCATCT
ATTTCGTCGGATGGTTCTTTTACATACTACGCAGACTCCGTGAAGGGCCG
GTTCACCATCTCCCGCGACAATTCCAAGAACACGCTGTATCTGGAAATGA
ACAGCATGCGTGCCGAGGATACCGCGGTATATTACTGTGCGGAACCGTTT
ACTGAGTTTGACAACTGGGGTCAGGGAACCCTCGTCACCGTCTCGAGC

BMS2h-719-6 (SEQ ID NO: 835)
GAGGTGCAGCTGTTGGAGTCTGGGGGAGGCTTGGTACAGCCTGGGGGGTC
CCTGCGTCTCTCCTGTGCAGCCTCCGGATTCACCTTTAAGAGGTATGAGA
TGATGTGGGTCCGCCAGGCTCCAGGGAAGGGTCTGGAGTGGGTCTCATCT
ATTTCGTCGGATGGTTCTTTTACATACTACGCAGACTCCGTGAAGGGCCG
GTTCACCATCTCCCGCGACAATTCCAAGAACACGCTGTATCTGCAAATGA
ACAGCCTGCGTGCCGAGGATACCGCGGTATATTACTGTGCAGAACCGTTT
ACTGAGTTTGACTACTGGGGTCAGGGAACCCAGGTCACCGTCTCGAGC

BMS2h-719-7 (SEQ ID NO: 836)
GAGGTGCAGCTGTTGGAGTCTGGGGGAGGCTTGGTACAGCCTGGGGGGTC
CCTGCGTCTCTCCTGTGCAGCCTCCGGATTCAACTTTAAGAGGTATGAGA
TGACGTGGGTCCGCCAGGCTCCAGGGAAGGGTCTGGAGTGGGTCTCATCT
ATTTCGTCGGATGGTTCTTTTACATACTACGCAGACTCCGTGAAGGGCCG

TABLE 2-continued

Human Anti-CD40L VH Domain Encoding Nucleotide Sequences

GTTCACCATCTCCCGCGACAATTCCAAGAACACGCTGTATCTGCAAATGA
ACAGCCTGCGTGCCGAGGATACCGCGGTATATTACTGTGCAGACCCGTTT
ACTGAGTTTGACTACTGGGGTCAGGGAACCCTGGTCACCGTCTCGAGC

BMS2h-719-8 (SEQ ID NO: 837)
GAGGTGCAGCTGTTGGAGTCTGGGGGAGACTTGGTACAGCCTGGGGGGTC
CCTGCGTCTCTCCTGTGCAGCCTCCGGATTCACCTTTAAGAGGTATGAGA
TGATGTGGGTCCGCCAGGCTCCAGGGAAGGGTCTGGAGTGGGTCTCATCT
ATTTCGTCGGATGGTTCTTTTACATACTACGCAGACTCCGTGAAGGGCCG
GTTCACCATCTCACGCGACAATTCCAAGAACACGCTGTATCTGCAAATGA
ACAGCCTGCGTGCCGAGGATACCGCGGTATATTACTGTGCGAACCGTTT
ACTGAGTTTGACTACAGGGGTCAGGGAACCCTGGTCACCGTCTCGAGC

BMS2h-719-9 (SEQ ID NO: 838)
GAGGTGCAGCTGTTGGAGTCTGGGGGAGGCTTGGTACAGCCTGGGGGGTC
CCTGCGTCTCTCCTGTGCAGCCTCCGGATTCACCTTTAAGAGGTATGAGA
TGTCGTGGGTCCGCCAGGCTCCAGGGAAGGGTCTGGAGTGGGTCTCATCT
ATTTCGTCGGATGGTTCTTTTACATACTACGCAGACTCCGTGAAGGGCCG
GTTCACCATCTCCCGCGACAATTCCAAGAACACGCTGTATCTGCAAATGA
ACAGCCTGCGTGCCGAGGATACCGCGGTATATTACTGTGCGAACCGTTT
ACTGAGTTTGACTACTGGGGTCGGGGAACCCTGGTCACCGTCTCGAGC

BMS2h-72 (SEQ ID NO: 839)
GAGGTGCAGCTGTTGGAGTCTGGGGGAGGCTTGGTACAGCCTGGGGGGTC
CCTGCGTCTCTCCTGTGCAGCCTCCGGATTCACCTTTGAGGCGTATCCTA
TGTCGTGGGTCCGCCAGGCTCCAGGGAAGGGTCTAGAGTGGGTCTCAAGT
ATTTCCCCTCTTGGTTTGTGGACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAACTTAGT
GCTGGGGCGAGACTCATGTTTATCGGCTTTTTGACTACTGGGGTCAGGG
AACCCTGGTCACCGTCTCGAGC

BMS2h-720 (SEQ ID NO: 840)
GAGGTGCAGCTGTTGGAGTCTGGGGGAGGCTTGGTACAGCCTGGGGGGTC
CCTGCGTCTCTCCTGTGCAGCCTCCGGATTCACCTTTGGTAATTATGAGA
TGATGTGGGTCCGCCAGGCTCCAGGGAAGGGTCTAGAGTGGGTCTCATCT
ATTGGGGTGTTGGGTCATACGACATACTACGCAGACTCCGTGAAGGGCCG
GTTCACCATCTCCCGCGACAATTCCAAGAACACGCTGTATCTGCAAATGA
ACAGCCTGCGTGCCGAGGATACCGCGGTATATTACTGTGCGAAACTTATG
TCGTTGAGGACGTTTGAGAATCTTTTTGACTACTGGGGTCAGGGAACCCT
GGTCACCGTCTCGAGC

BMS2h-722 (SEQ ID NO: 841)
GAGGTGCAGCTGTTGGAGTCTGGGGGAGGCTTGGTACAGCCTGGGGGGTC
CCTGCGTCTCTCCTGTGCAGCCTCCGGATTCACCTTTACGAAGTATCCTA
TGGCTTGGGTCCGCCAGGCTCCAGGGAAGGGTCTAGAGTGGGTCTCAGGT
ATTGATGCTAATGGTAATAGGACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAGGGACT
TGGCGTAGGCATTTTGCGATTTTTGACTACTGGGGTCAGGGAACCCTGGT
CACCGTCTCGAGC

BMS2h-723 (SEQ ID NO: 842)
GAGGTGCAGCTGTTGGAGTCTGGGGGAGGCTTGGTACAGCCTGGGGGGTC
CCTGCGTCTCTCCTGTGCAGCCTCCGGATTCACCTTTGATCTGTATGATA
TGATGTGGGTCCGCCAGGCTCCAGGGAAGGGTCTAGAGTGGGTCTCATCT
ATTTCTGATCTGGGTACGCTTACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAAAATGGT
TTTAGGGTTACGAGTAATGATCGTAGGTTTGACTACTGGGGTCAGGGAAC
CCTGGTCACCGTCTCGAGC

BMS2h-724 (SEQ ID NO: 843)
GAGGTGCAGCTGTTGGAGTCTGGGGGAGGCTTGGTACAGCCTGGGGGGTC
CCTGCGTCTCTCCTGTGCAGCCTCCGGATTCACCTTTACTGGTGGGATA
TGTGGTGGGTCCGCCAGGCTCCAGGGAAGGGTCTAGAGTGGGTCTCAATG
ATTGAGGGTGGTGGTGTGACTACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAACTTGAT
CTTCGGACGGGTCAGTTTGACTACTGGGGTCAGGGAACCCTGGTCACCGT
CTCGAGC

BMS2h-725 (SEQ ID NO: 844)
GAGGTGCAGCTGTTGGAGTCTGGGGGAGGCTTGGTACAGCCTGGGGGGTC
CCTGCGTCTCTCCTGTGCAGCCTCCGGATTCACCTTTTCGGCTTATACTA
TGGGTTGGGTCCGCCAGGCTCCAGGGAAGGGTCTGGAGTGGGTCTCACTT
ATTGGGGATCGTGGTTCTTGGACATACTACGCAGACTCCGTGAAGGGCCG

GTTCACCATCTCCCGCGACAATTCCAAGAACACGCTGTATCTGCAAATGA
ACAGCCTGCGTGCCGAGGACACCGCGGTATATTACTGTGCGGAACCGTCG
GATCCTACTAAGTTTGACTACTGGGGTCAGGGAACCCTGGTCACCGTCTC
GAGC

BMS2h-725-1 (SEQ ID NO: 845)
GAGGTGCAGCTGTTGGAGTCTGGGGGAGGCTTGGTACAGCCTGGGGGGTC
CCTGCATCTCTCCTGTGCAGCCTCCGGATTCACCTTTTCGGCTTATACTA
TGGGTTGGGTCCGCCAGGCTCCAGGGAAGGGTCTGGAGTGGGTCTCACTT
ATTGGGGATCGTGGTTCTTGGACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTTCTGTGCGGATCCGTCG
GATCCTACTAAGTTTGACTACTGGGGTCAGGGAACCCTGGTCACCGTCTC
GAGC

BMS2h-725-10 (SEQ ID NO: 846)
GAGGTGCAGCTGTTGGAGTCTGGGGGAGGCTTGGTACAGCCTGGGGGGTC
CCTGCGTCTCTCCTGTGCAGCCTCCGGATTCACCTTTTCGGCTTATACTA
TGGGTTGGGTCCGCCAGGCTCCAGGGAAGGGTCTGGAGTGGGTCTCACTT
ATTGGGGATCGTGGTTCTTGGACATACTACGCAGACTCCGTGAAGGGCCG
GTTCACCATCTCCCGTGACAATTCCAAGAACACGCTGTATCTGCAAATGA
ACAGCCTGCGTGCCGAGGACACCGCGGTATATTACTGTGCGGATCCGTCG
GATCCTACTAAGTTTGACTACTGGGGTCAGGGAACCCTGGTCACCGTCTC
GAGC

BMS2h-725-11 (SEQ ID NO: 847)
GAGGTGCAGCTGTTGGAGTCTGGGGGAGGCTTGGTACAGCCTGGGGGGTC
CCTGCGTCTCTCCTGTGCAGCCTCCGGATTCACCTTTTCGGCTTATACTA
TGGGTTGGGTCCGCCAGGCTCCAGGGAAGGGTCTGGAGTGGGTCTCACTT
ATTGGGGATCGTGGTTCTTGGACATACTACGCAGACTCCGTGAAGGGCCG
GTTCACCATCTCCCGCGACAATTCCAAGAACACGCTGTATCTGCAAATGA
GCAGCCTGCGTGCCGAGGACACCGCGGTATATTACTGTGCGGATCCGTCG
GATCCTACTAAGTTTGACTACTGGGGTCAGGGAACCCTGGTCACCGTCTC
GAGC

BMS2h-725-12 (SEQ ID NO: 848)
GAGGTGCAGCTGTTGGAGTCTGGGGGTGGCTTGGTACAGCCTGGGGGGTC
CCTGCGTCTCTCCTGTGCAGCCTCCGGATTCACCTTCCCGGCTTATACTA
TGGGTTGGGTCCGCCAGGCTCCAGGGAAGGGTCTGGAGTGGGTCTCACTT
ATTGGGGATCGTGGTTCTTGGACATACTACGCAGACTCCGTGAAGGGCCG
GTTCACCATCTCCCGCGACGATTCCAAGAACACGCTGTATCTGCAAATGA
ACAGCCTGCGTGTCGAGGACACCGCGGTATATTACTGTGCGGAACCGTCG
GATCCTACTATGTTTGTCTACTGGGGTCAGGGAACCCTTGTCACCGTCTC
GAGC

BMS2h-725-13 (SEQ ID NO: 849)
GAGGTGCAGCTGTTGGAGTCTGGGGGAGGCTTGGTACAGCCTGGGGGGTC
CCTGCGTCTCTCCTGTGCAGCCTCCGGATTCACCTTTTCGGCTTATACTA
TGGGCTGGGTCCGCCAGGCTCCAGGGAAGGGTCTGGAGTGGGTCTCTCTT
ATTGGGGATCGTGGTTCTTGGACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGGAACCGTCG
GATCCTACTATGTTTGTCTACTGGGGTCAGGGAACCCTGGTCACCGTCTC
GAGC

BMS2h-725-14 (SEQ ID NO: 850)
GAGGTGCAGCTGTTGGAGTCTGGGGGAGGCTTGGTACAGCCTGGGGGGTC
CCTGCGTCTCTCCTGTGCAGCATCCGGATTCACCTTTTCGGCTTATACTA
TGGGTTGGGTCCGCCAGGCTCCAGGGAAGGGTCTGGAGTGGGTCTCACTT
ATTGGGGATCGTGGTTCTTGGACATACTACGCAGACTCCGTGAAGGGCCG
GTTCACCATCTCCCGTGACAATTCCAAGAACACGCTGTATCTGCAAATGA
ACAGCCTGCGTGCCGAGGACACCGCGGTATATTACTGTGCGGATCCGTCA
GATCCTACTATGTTTGACTACTGGGGTCAGGGAACCCTGGTCACCGTCTC
GAGC

BMS2h-725-15 (SEQ ID NO: 851)
GAGGTGCAGCTGTTGGAGTCTGGGGGGGGCATGGTACAGCCTGGGGGGTC
CCTGCGTCTCTCCTGTGCAGCCTCCGGATTCACCTTTTCGGCTTATACTA
TGGGTTGGGTCCGCCAGGCTCCAGGGAAGGGTCTGGAGTGGGTCTCACTT
ATTGGGGATCGTGGTTCTTGGACATACTACGCAGACTCCGTGAAGGGCCG
GTTCACCATCTCCCGCGACAATTCCAAGAACACGCTGTATCTGCAAATGA
ACATGCCTGCGTGCCGAGGACACCGCGGTATATTACTGTGCGGATCCGTCG
GATCCTACTAAGTTTGACTACTGGGGTCAGGGAACCCTGGTCACCGTCTC
GAGC

BMS2h-725-16 (SEQ ID NO: 852)
GAGGTGCAGCTGTTGGAGTCTGGGGGAGGCTTGGTACAGCCTGGGGGGTC

TABLE 2-continued

Human Anti-CD40L VH Domain Encoding Nucleotide Sequences

CCTGCGTCTCTCCTGTGCAGCCTCCGGATTCACCTTTTCGGCTTATACTA
TGGGTTGGGTCCGCCAGGCTCCAGGGAAGGGTCTGGAGTGGGTCACACTT
ATTGGGGATCGTGGTTCTTGGACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGGAACCGTCG
GATCCTACTATGTTTGACTACTGGGGTCAGGGAACCCTGGTCACCGTCTC
GAGC

BMS2h-725-17 (SEQ ID NO: 853)
GAGGTGCAGCTGTTGGAGTCTGGGGGAGGCTTGGTCAGCCTGGGGGGTC
CCTGCGTCTCTCCTGTGCAGCCTCCGGATTCACCTTTACGGCTTATACTA
TGGGTTGGGTCCGCCAGGCTCCAGGGAAGGGTCTGGAGTGGGTCTCACTT
ATTGGGGATCGTGGTTCTTGGACATACTACGCAGACTCCGTGAAGGGCCG
GTTCACCATCTCCCGCGACAATTCCAAGAACACACTGTATCTGCAAATGA
ACAGCCTGCGTGCCGAGGACACCGCGGTATATTACTGTGCGGAACCGTCG
GATCCTACTAAGTTAGACTACTGGGGTCAGGGAACCCTGGTCACCGTCTC
GAGC

BMS2h-725-18 (SEQ ID NO: 854)
GAGGTGCAGCTGTCGGAGTCTGGGGGAGGCTTGGTACAGCCTGGGGGGTC
CCTGCGTCTCACCTGTGCAGCCTCCGGATTCACCTTTTCGGCTTATACTA
TGGGTTGGGTCCGCCAGGCTCCAGGGAAGGGTCTGGAGTGGGTCTCACTT
ATTGGGGATCGTGGTTCTTGGACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGGATCCGTCG
GATCCTACTAAGTTTGTCTACTGGGGTCAGGGAACCCTGGTCACCGTCTC
GAGC

BMS2h-725-19 (SEQ ID NO: 855)
GAGGTGCAGCTGTTGGAGTCTGGGGGAGGCTTGGTACAGCCTGGGGGGTC
CCTGCGTCTCTCCTGTGCAGCCTCCGGATTCACCTTTTCGGCTTATACTA
TGGGTTGGGTCCGCCAGGCTCCAGGGAAGGGTCTGGAGTGGGTCTCACTT
ATTGGGGATCGTGGTTCTTGGACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCAGATCCGTCG
GATCCTACTAAGTTTGTCTACTGGGGTCAGGGAACCCTGGTCACCGTCTC
GAGC

BMS2h-725-2 (SEQ ID NO: 856)
GAGGTGCAGCTGTTGGAGTCTGGGGGAGGCTTGGTACAGCCTGGGGGGTC
CCTGCGTCTCTCCTGTGCAGCCTCCGGATTCACCTTTTCGGCTTATACTA
TGGGTTGGGTCCGCCAGGCTCCAGGGAAGGGTCTGGAGTGGGTCTCACTT
ATTGGGGATCGTGGTTCTTGGACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGGAACCGTCG
GATCCTACTAAGTTTGTCTACTGGGGTCAGGGAACCCGGTCACCGTCTC
GAGC

BMS2h-725-3 (SEQ ID NO: 857)
GAGGTGCAGCTGTTGGAGTCTGGGGGAGGCTTGGTACAGCCTGGGGGGTC
CCTGCGTCTCTCCTGTGCAGCCTCCGGATTCACCTTTTCGGCTTATACTA
TGGGTTGGGTCCGCCAGGCTCCAGGGAAGGGTCTGGAGTGGGTCTCGCTT
ATTGGGGATCGTGGTTCTTGGACATACTACGCAGACTCCGTGAAGGGCCG
GTTCACCATCTCCCGCGACAATTCCAGGAACATGCTGTATCTGCAAATGA
AAAGCCTGCGTGCCGAGGACACCGCGGTATATTACTGTGCGCGGATCCGTCG
GATCCTACTAAGTTTGTCTACTGGGGTCAAGGAACCCAGGTCACCGTCTC
GAGC

BMS2h-725-4 (SEQ ID NO: 858)
GAGGTGCAGCTGTTGGAGTCTGGGGGAGGCTTGGTACAGCCTGGGGGGTC
CCTGCGTCTCTCCTGTGCAGCCTCCGGATTCACCTTTTCGGCTTATACTA
TGGGTTGGGTCCGCCAGGCTCCAGGGAAGGGTCTGGAGTGGGTCTCACTT
ATTGGGGATCGTGGTTCTTGGACATACTACGCAGACTCCGTGAAGGGCCG
GTTCACCATCTTCCGCGACAATTCCAAGAACACGCTGTATCTGCAAATGA
ACAGCCTGCGTGCCGAGGACACCGCGGTATATTACTGTGCGGATCCGTCG
GATCCTACTAAGTTTGTCTACTGGGGTCAGGGAACCCTGGTCACCGTCTC
GAGC

BMS2h-725-5 (SEQ ID NO: 859)
GAGGTGCAGCTGTTGGAGTCTGGGGGAGGCTTGGTTACAGCCTGGGGGGTC
CCTGCGTCTCTCCTGTGCAGCCTCCGGATTCACCTTTTCGGATTATACTA
TGGGTTGGGTCCGCCAGGCTCCAGGGAAGGGTCTGGAGTGGGTCTCACTT
ATTGGGGATCGTGGTTCTTGGACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGGAACCGTCG
GATCCTACTAAGTTCGACTACTGGGGTCGGGGAACCCTGGTCACCGTCTC
GAGC

BMS2h-725-6 (SEQ ID NO: 860)
GAGGTGCAGCTGTTGGAGTCTGGGGGAGGCTTGGTACAGCCTGGGGGGTC
CCTGCGTCTCTCCTGTGCAGCCTCCGGATTCACCTTTTCGGCTTATACTA
TGGGTTGGGTCCGCCAGGCTCCAGGGAAGGGTCTGGAGTGGGTCTCACTT
ATTGGGGATCGTGGTTCTTGGACATACTACGCAGACTCCGTGAAGGGCCG
GTTCACCATCTCACGCGACAATTCCAAGAACACGCTGTATCTGCAAATGA
ACAGCCTGCGTGCCGAGGACACCGCGGTATATTACTGTGCGGAACCGTCC
GATCCTACTAAGTTTGTCTACTGGGGTCAGGGAACCCTGGTCACCGTCTC
GAGC

BMS2h-725-7 (SEQ ID NO: 861)
GAGGTGCAGCTGTTGGAGTCTGGGGGAGGCTTGGTACAGCCTGGGGGGTC
CCTGCGTCTCTCCTGTGCAGCCTCCGGATTCACCTTTTCGGCTTATACTA
TGGGTTGGGTCCGCCAGGCTCCAGGGAAGGGTCTGGAGTGGGTCTCACTT
ATTGGGGATCGTGGTACTTGGACATATTACGCAGACCCCGTGAAGGGCCG
GTTCACCATCTCCCGCGACAATTCCAAGAACACACTGTATCTGCAAATGA
ACAGCCTGCGTGCCGAGGACACTGCGGTATATTATTGTGCGGATCCGTCG
GATCCTACTAAGTTTGACTACTGGGGTCAGGGAACCCTGGTCACCGTCTC
GAGC

BMS2h-725-8 (SEQ ID NO: 862)
GAGGTGCAGCTGTTGGAGTCTGGGGGAGGCTTGGTACAGCCTGGGGGGTC
CCTGCGTCTCTCCTGTGCAGCCTCCGGATTCACCTTTTCGGCTTATACTA
TGGGTTGGGTCCGCCAGGCTCCAGGGAAGGGTCTGGAGTGGGTCTCACTT
ATTGGGGATCGTGGTTCTTGGACATACTACGCAGACTCCGTGAAGGGCCG
GTTCACCGATCTCCCGCGACAATTCCAAGAACACGCTGTATCTGCAAATGA
ACAGCCTGCGTGCCGAGGACACCGCGGTATATTACTGTGCGGAACCGTCG
GATCCTACTAAGTTTGACTACTGGGGTCAGGGAACCCTGGTCACCGTCTC
GAGC

BMS2h-725-9 (SEQ ID NO: 863)
GAGGTGCAGCTGTTGGAGTCTGGGGGAGGCTTGGTACAGCCTGGGGGGTC
CCTGCGTCTCTCCTGTGCAGCCTCCGGATTCACCTTTTCGGCTTATACTA
TGGGTTGGGTCCGCCAGGCTCCAGGGAAGGGTCTGGAGTGGGTCTCACTT
ATTGGGGATCGTGGTTCTTGGACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGGAACCGTCG
GATCCTACTAAGTTTGACTACTGGGGTCAGGGAACCCTGGTCACCGTCTC
GAGC

BMS2h-726 (SEQ ID NO: 864)
GAGGTGCAGCTGTTGGAGTCTGGGGGAGGCTTGGTACAGCCCGGGGGGTC
CCTGCGTCTCTCCTGTGCAGCCTCCGGATTCACCTTTGATAATTATAAGA
TGTATTGGGTCCGCCAGGCTCCAGGGAAGGGTCTGGAGTGGGTCTCAAGT
ATTTCGGAGATAGGTAATCTGACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGATAGCTCTG
ACGCGTTTTGACTACTGGGGTCAGGGAACCCTGGTCACCGTCTCGAGC

BMS2h-727 (SEQ ID NO: 865)
GAGGTGCAGCTGTTGGAGTCTGGGGGAGGCTTGGTACAGCCTGGGGGGTC
CCTGCGTCTCTCCTGTGCAGCCTCCGGATTCACCTTTGCGAGTTATCGTA
TGTATTGGGTCCGCCAGGCTCCAGGGAAGGGTCTGGAGTGGGTCTCATAT
ATTGATCCGCGGGTAGTCGTACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAAAGTTTG
AATTTGTCGTTTCCTTATATTAATTTTGACTACTGGGGTCAGGGAACCCT
GGTCACCGTCTCGAGC

BMS2h-728 (SEQ ID NO: 866)
GAGGTGCAGCTGTTGGAGTCTGGGGGAGGCTTGGTACAGCCTGGGGGGTC
CCTGCGTCTCTCCTGTGCAGCCTCCGGATTCACCTTTGAGCGGTATGAGA
TGCTGTGGGTCCGCCAGGCTCCAGGGAAGGGTCTAGAGTGGGTCTCACGT
ATTTCTCATTCGGGTCGGACGACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGCAATTGGAT
GGTCCGTTTGACTACTGGGGTCAGGGAACCCTGGTCACCGTCTCGAGC

BMS2h-729 (SEQ ID NO: 867)
GAGGTGCAGCTGTTGGAGTCTGGGGGAGGCTTGGTACAGCCTGGGGGGTC
CCTGCGTCTCTCCTGTGCAGCCTCCGGATTCACCTTTAAGAGGTATTATA
TGGATTGGGTCCGCCAGGCTCCAGGGAAGGGTCTAGAGTGGGTCTCAAGG
ATTAATCATAATGGTTCTGTTACATACTACGCAGACTCCGTGAAGGGCCG
GTTCACCATCTCCCGCGACAATTCCAAGAACACGCTGTATCTGCAAATGA
ACAGCCTGCGTGCCGAGGATACCGCGGTATATTACTGTGCGAAAAATGCCG

TABLE 2-continued

Human Anti-CD40L VH Domain Encoding Nucleotide Sequences

CAGGGTACTTCTGATTGGTATTATTTTGACTACTGGGGTCAGGGAACCCT
GGTCACCGTCTCGAGC

BMS2h-73 (SEQ ID NO: 868)
GAGGTGCAGCTGTTGGAGTCTGGGGGAGGCTTGGTACAGCCTGGGGGGTC
CCTGCGTCTCTCCTGTGCAGCCTCCGGATTCACCTTTTCTAAGTATGATA
TGTCTTGGGTCCGCCAGGCTCCAGGGAAGGGTCTAGAGTGGGTCTCAACT
ATTCTGGAGGATGGTCTGACTACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAACGGGG
CGTTTGTTTGACTACTGGGGTCAGGGAACCCTGGTCACCGTCTCGAGC

BMS2h-74 (SEQ ID NO: 869)
GAGGTGCAGCTGTTGGAGTCTGGGGGAGGCTTGGTACAGCCTGGGGGGTC
CCTGCGTCTCTCCTGTGCAGCCTCCGGATTCACCTTTTCGGATTATCCTA
TGACGTGGGTCCGCCAGGCTCCAGGGAAGGGTCTGGAGTGGGTCTCAACT
ATTCTGTCTCCGGGTACGGAGACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAAGCTGAG
AAGGATTTTGACTACTGGGGTCAGGGAACCCTGGTCACCGTCTCGAGC

BMS2h-741 (SEQ ID NO: 870)
GAGGTGCAGCTGTTGGAGTCTGGGGGAGGCTTGGTACAGCCTGGGGGGTC
CCTGCGTCTCTCCTGTGCAGCCTCCGGATTCACCTTTGAGGGTGGTGAGA
TGGGTTGGGTCCGCCAGGCTCCAGGGAAGGGTCTAGAGTGGGTCTCAATG
ATTCCGATGGATGGTAGTGCGACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAAGCGGGT
GAGGTGTTTGACTACTGGGGTCAGGGAACCCTGGTCACCGTCTCGAGC

BMS2h-742 (SEQ ID NO: 871)
GAGGTGCAGCTGTTGGAGTCTGGGGGAGGCTTGGTACAGCCTGGGGGGTC
CCTGCGTCTCTCCTGTGCAGCTCCGGATTCACCTTTAGGGAGTATCATA
TGAAGTGGGCCCGCCAGGCTCCAGGGAAGGGTCTAGAGTGGGTCTCAGGG
ATTAGTAGGGATGGTATGAATACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGATACAGCTT
GCTTTGTTTGACTACTGGGGTCAGGGAACCCTGGTCACCGTCTCGAGC

BMS2h-743 (SEQ ID NO: 872)
GAGGTGCAGCTGTTGGAGTCTGGGGGAGGCTTGGTACAGCCTGGGGGGTC
CCTGCGCCTCTCCTGTGCAGCCTCCGGATTCACCTTTCGTGATTATGAGA
TGCTTTGGGCCCGCCAGGCTCCAGGGAAGGGTCTAGAGTGGGTCTCAGGT
ATTCTTCCGTCGGGTGGGGCTACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAAGCTGGT
TCGGGGAATGGGCCTATTCTTTTTGACTACTGGGGTCAGGGAACCCTGGT
CACCGTCTCGAGC

BMS2h-744 (SEQ ID NO: 873)
GAGGTGCAGCTGTTGGAGTCTGGGGGAGGCTTGGTACAGCCTGGGGGGTC
CCTGCGTCTCTCCTGTGCAGCCTCCGGATTCACCTTTAAGGAGCATGATA
TGTTTTGGGTCCGCCAGGCTCCAGGGAAGGGTCTAGAGTGGGTCTCAGGG
ATTGGGGCTGAGGGTGTTTGGACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGGAACCGACG
ATGTCTAATGGTTCTCAGTCGCGTTTTGACTACTGGGGTCAGGGAACCCT
GGTCACCGTCTCGAGC

BMS2h-745 (SEQ ID NO: 874)
GAGGTGCAGCTGTTGGAGTCTGGGGGAGGCTTGGTACAGCCTGGGGGGTC
CCTGCGTCTCTCCTGTGCAGCCTCCGGATTCACCTTTGATAATACTGAGA
TGGCTTGGGTCCGCCAGGCTCCAGGGAAGGGTCTAGAGTGGGTCTCAGGT
ATTATTGAGGATGGTAATCGTACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAAATTCGT
AATCTGCATTGGGATGTGGGGAGGCAGTTTGACTACTGGGGTCAGGGAAC
CCTGGTCACCGTCTCGAGC

BMS2h-745-1 (SEQ ID NO: 875)
GAGGTGCAGCTGTTGGAGTCTGGGGGAGGCTTGGTACAGCCTGGGGGGTC
CCTGCGTCTCTCCTGTGCAGCCTCCGGATTCACCTTTGATAATACTGAGA
TGGCTTGGGTCCGCCAGGCTCCAGGGAAGGGTCTAGAGTGGGTTTCAGGT
ATTACTGAGGATGGTAATCGTACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAAATTCGT
AATCTGCATTGGGATGTGGGGAGGCAGTTTGACTACTGGGGTCAGGGAAC
CCTGGTCACCGTCTCGAGC

BMS2h-745-10 (SEQ ID NO: 876)
GAGGTGCAGCTGTTGGAGTCTGGGGGAGGCTTGGTACAGCCTGGGGGGTC
CCTTCGTCTCTCCTGTGCAGCCTCCGGATTCACCTTTGATAATACTGAGA
TGGCTTGGGTCCGCCAGGCTCCAGGGAAGGGTCTAGAGTGGGTCTCAGGT
ATTACTGAGGATGGTAATCGTACATACTACGCAGACTCCGTGAAGGGCCG
GTTCACCATCTCCCGCGACAATTCCAAGAACACGCTGTATCTGCAAATGA
ACAACCTGCGTGCCGAAGACACCGCGTATATTACTGTGCGAAAATTCGT
AATCTGCATTGGGATGTGGGGAGGCAGTTTGACTACTGGGGTCAGGGAAC
CCTGGTCACCGTCTCGAGC

BMS2h-745-11 (SEQ ID NO: 877)
GAGGTGCAGCTGTTGGAGTCTGGGGGAGGCTTGGTACAGCCTGGGGGGTC
CCTGCGTCTCTCCTGTGCAGCCTCCGGATTCACCTTTGATAATACTGAGA
TGGCTTGGATCCGCCAGGCTCCAGGGAAGGGTCTAGAGTGGGTCTCAGGT
ATTACTGAGGATGGTAATCGTACATACTACGCAGACTCCGTGAAGGGCCG
GTTCACCATCTCCCGCGACAATTTCAAGAACACGCTGTATCTGCAGATGA
ACAGCCTGCGTGCCGAGGACACCGCGGTATATTACTGTGCGAAAATTCGT
AATCTGCATTGGGATGTGGGGAGGCAGTTTGACTACTGGGGTCAGGGAAC
CCTGGTCACCGTCTCGAGC

BMS2h-745-12 (SEQ ID NO: 878)
GAGGTGCAGCTGTTGGAGTCTGGGGGAGGCTTGGTACAGCCTGGGGGGTC
CCTGCGTCTCTCCTGTGCAGCCTCCGGATTCACCTTTGATAATACTGAGA
TGGCTTGGGTCCGCCAGGCTCCAGGGAAGGGTCTAGAGTGGGTCTCAGGT
ATTACTGAGGATGGTAATCGTACATACTACGCAGATTCCGTGAAGGGCCG
GTTCACCATCTCCCGCGACAATTCCATGAACACGCTGTATCTGCAAATGA
ACAGCCTGCGTGCCGAGGACACCGCGGTATATTACTGTGCGAAAATTCGT
AATCTGCATTGGGATGTGGGGAGGCAGTTTGTCTACTGGGGTCAGGGAAC
CCTGGTCACCGTCTCGAGC

BMS2h-745-13 (SEQ ID NO: 879)
GAGGTGCAGCTGTTGGAGTCTGGGGGAGGCTTGGTACAGCCTGGGGGGTC
CTTGCGTCTCTCCTGTGCAGCCTCCGGATTCACCTTTGATAACACTGAGA
TGGCTTGGATCCGCCAGGCTCCAGGGAAGGGTCTAGAGTGGGTCTCAGGT
ATTATTGAGGATGGTAATCGTACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAAATTCGT
AATCTGCATTGGGATGTGGGGAGGCAGTTTGACTACTGGGGTCAGGGAAC
CCTGGTCACCGTCTCGAGC

BMS2h-745-14 (SEQ ID NO: 880)
GAGGTGCAGCTGTTGGAGTCTGGGGGAGGCTTGGTACAGCCTGGGGGGTC
CCTGCGTCTCTCCTGTGCAGCCTCCGGGTTCACCTTTGATAATACTGAGA
TGGCTTGGATCCGCCAGGCTCCAGGGAAGGGTCTAGAGTGGGTCTCAGGT
ATTACTGAGGATGGTAATCGTACATACTACGCAGACTCCGTGAAGGGCCG
GTTCACCATCTCCCGCGACAATTCCAAGAACACGCTGTATCTGCAAATGA
ACAGCCTGCGTGCTGAGGACACCGCGGTATATTACTGTGCGAAAATTCGT
AATCTGCATTGGGATGTGGGGAGGCAGTTTGACTACTGGGGTCAGGGAAC
CCTGGTCACCGTCTCGAGC

BMS2h-745-15 (SEQ ID NO: 881)
GAGGTGCAGCTGTTGGAGTCTGGGGGAGGCTTGGTACAGCCAGGGGGGTC
CCTGCGTCTCTCCTGTGCAGCTCTGGATTCACCTTTGATAATACTGAGA
TGGCTTGGATCCGCCAGGCTCCAGGGAAGGGTCTAGAGTGGGTCTCAGGT
ATTACTGAGGATGGTAATCGTACATACTACGCAGACTCCGTGAAGGGCCG
GTTCACCATCTCCCGCGACAATTCCAAGAACGCGCTGTATCTGCAAATGA
ACAGCCTGCGTGCCGAGGACACCGCGGTATATTACTGTGCGAAAATTCGT
AATCTGCATTGGGATGTGGGGAGGCAGTTTGACTACTGGGGTCTGGGAAC
CCTGGTCACCGTCTCGAGC

BMS2h-745-16 (SEQ ID NO: 882)
GAGGTGCAGCTGTTGGAGTCTGGGGGAGGCTTGGTACAGCCTGGGGGGTC
CCTGCGTCTCTCCTGTGCAGCCTCCGGATTCACCTTTGATAATACTGAGA
TGGCTTGGGTCCGCCAGGCTCCAGGGAAGGGTCTAGAGTGGGTCTCAGGT
ATTACTGAGGATGGTAATCGTACATACTACGCAGACTCCGTGAAGGGCCG
GTTCACCATCTCCCGCGACAATACCAAGAACACGCTGTATCTGCAAATGA
ACAGCCTGCGTGCCGAGGACACCGCGGTATATTACTGTGCGAAAATTCGT
AATCTGCATTGGGATGTGGGGAGGCAGTTTGTCTACTGGGGTCAGGGAAC
CCTGGTCACCGTCTCGAGC

BMS2h-745-17 (SEQ ID NO: 883)
GAGGTGCAGCTGTTGGAGTCTGGGGGAGGCTTGGTACAGCCTGGGGGGTC
CCTGCGTCTCTCCTGTGCAGCCTCCGGATTCACCTTTGATAATACTGAGA
TGGCCTGGATCCGCCAGGCTCCAGGGAAGGGTCTAGAGTGGGTCTCAGGT

TABLE 2-continued

Human Anti-CD40L VH Domain Encoding Nucleotide Sequences

ATTATTGAGGATGGTAATCGTACATACTACGCAGACTCCGTGAAGGGCCG
GTTCACCATCTCCCGCGACAATTCCAAGAACAGGCTGTATCTGCAAATGA
ACAGCCTGCGTGCCGAGGACACCGCGGTATATTACTGTGCGAAAATTCGT
AATCTGCATTGGGATGTGGGGAGGCAGTTTGACTACTGGGGTCAGGGCAC
CCTGGTCACCGTTTCGAGC

BMS2h-745-18 (SEQ ID NO: 884)
GAGGTGCAGCTGTTGGAGTCTGGGGGAGGCTTGGTACAGCCTGGGGGGTC
CCTGCGTCTCTCCTGTGCAGCCTCCGGATTCACCTTTGATAATACTGAGA
TGGCTTGGGTCCGCCAGGCTCCAGGGAAGGGTCTAGAGTGGGTCTCAGGT
ATTACTGAGGATGGTAATCGTACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATCACTGTGCGAAAATTCGT
AATCTGCATTGGGATGTGGGGAGGCAGTTTGACTACTGGGGTCAGGGAAC
CCTCGTCACCGTCTCGAGC

BMS2h-745-19 (SEQ ID NO: 885)
GAGGTGCAGCTGTTGGAGTCTGGGGGAGGCTTGGTACAGCCTGAGGGGTC
CCTGCGTCTCTCCTGTGCAGCCTCCGGATTCACCTTTGATAATACTGAGA
TGGCTTGGGTCCGCCAGGCTCCAGGGAAGGGTCTAGAGTGGGTCTCAGGT
ATTATTGAGGATGGTAATCGTACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAAATTCGT
AATCTGCATTGGGATGTGGGGAGGCAGTTTGACTACTGGGGTCAGGGAAC
CCTGGTCACCGTCTCGAGC

BMS2h-745-2 (SEQ ID NO: 886)
GAGGTGCAGCTGTTGGAGTCTGGGGGAGGCTTGGTACAGCCTGGGGGGTC
CCTGCGTCTCTCCTGTGCAGCCTCCGGATTCACCTTTGATAATACTGAGA
TGGCTTGGGTCCGCCAGGCTCCAGGGAAGGGTCTAGAGTGGGTCTCAGGT
ATTAGTGAGGATGGTAATCGTACATACTACGCAGACTCCGTGAAGGGCCG
GTTCACCATCTCCCGCGACAATTCCAAGAACACGCTGTATCTGCAAATGA
ACAGCCTGCGTGCAGAGGACTCCGCGGTATATTACTGTGCGAAAATTCGT
AATCTGCATTGGGATGTGGGGAGGCAGTTTGTCTACTGGGGTCAGGGAAC
CCTGGTCACCGTCTCGAGC

BMS2h-745-3 (SEQ ID NO: 887)
GAGGTGCAGCTGTTGGAGTCTGGGGGAGGCTTGGTAGAGCCTGGGGGGTC
CCTGCGTCTCTCCTGTGCAGCCTCCGGATTCACCTTTGATAATACTGAGA
TGGCTTGGGTCCGCCAGGCTCCTGGGAAGGGTCTCGAGTGGGTCTCAGGT
ATTACTGAGGATGGTAATCGTACATACTACGCAGACTCCGTGAAGGGCCG
GTTCACCATCTCCCGCGACAATTCCAAGAACACGCTGTATCTGCAAATGA
GCAGCCTGCGTGCCGAGGACACCGCGGTATATTACTGTGCGAAAATTCGT
AATCTGCATTGGGATGTGGGGAGGCAGTTTGACTACTGGGGTCAGGGAAC
CCTGGTCACCGTCTCGAGC

BMS2h-745-4 (SEQ ID NO: 888)
GAGGTGCAGCTGTTGGAGTCTGGGGGAGGCTTGGTACAGCCTGGGGGGTC
CCTGCGTCTCTCCTGTGCAGCCTCCGGATTCACCTTTGATAATACTGAGA
TGGCTTGGGTCCGCCAGGCTCAGGGAAGGGTCTAGAGTGGGTCTCAGGT
ATTAGTGAGGATGGTAATCGTACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATCACTGTGCGAAAATTCGT
AATCTGCATTGGGATGTGGGGAGGCAGTTTGACTACTGGGGTCAGGGAAC
CCTGGTCACCGTCTCGAGC

BMS2h-745-5 (SEQ ID NO: 889)
GAGGTGCAGCTGTTGGAGTCTGGGGGAGGCTTGGTACAGCCTGGGGGGTC
CCTGCGTCTCTCCTGTGCAGCCTCCGGATTCACCTTTGATAATACTGAGA
TGGCTTGGGTCCGCCAGGCTCCAGGGAAGGGTCTAGAGTGGGTCTCAGGT
ATTACTGAGGATGGTAATCGTACATACTACGCTGACTCCGTGAAGGGCCG
GTTCATCATCTCCCGCGACAATTCCAAGAACACGCTGAATCTGCAAATGA
ACAGCCTGCGTGCCGAGGACACCGCGGTATATTACTGTGCGAAAATTCGT
AATCTGCATTGGGATGTGGGGAGGCAGTTTGACTACTGGGGTCAGGGAAC
CCTGGTCACCGTCTCGAGC

BMS2h-745-6 (SEQ ID NO: 890)
GAGGTGCAGCTGTTGGAGTCTGGGGGAGGCTTGGTACAGCCTGGGGGGTC
CCTGCGTCTCTCCTGTGCAGCCTCCGGATTCACCTTTGATAATACTGAGA
TGGCTTGGATCCGCCAGGCTCCAGGGAGGGGTCTAGAGTGGGTCTCAGGT
GTTACTGAGGATGGTAATCGTACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAAATTCGT
AATCTGCATTGGGATGTGGGGAGGCAATTTGACTACTGGGGTCAGGGAAC
CCTGGTCACCGTCTCGAGC

BMS2h-745-7 (SEQ ID NO: 891)
GAGGTGCAGCTGTTGGAGTCAGGGGGAGGCTTGGTACAGCCTGGGGGGTC
CCTGCGTCTCTCCTGTGAAGCCTCCGGATTCACCTTTGATAATACTGAGA
TGGCTTGGATCCGCCAGGCTCCAGGGAAGGGTCTAGAGTGGGTCTCAGGT
ATTATTGAGGATGGTAATCGTACATACTACGCAGACTCCGTGAAGGGCCG
GTTCACCATCTCCCGCGACAATACCAAGAACACGCTGTATCTGCAAATGA
ACAGCCTGCGTGCCGAGGACACCGCGGTATATTATTGTGCGAAAATTCGT
AATCTGCATTGGGATGTGGGGAGGCAGTTTGACTACTGGGGTCAGGGAAC
CCTGGTCACCCGTCTCGAGT

BMS2h-745-8 (SEQ ID NO: 892)
GAGGTGCAGCTGTTGGAGTCTGGGGGAGGCTTGGTACAGCCTGGGGGGTC
CCTGCGTCTCTCCTGTGCAGCCTCCGGATTCACCTTTGATAATACTGAGA
TGGCTTGGATCCGCCAGGCTCCAGGGAAGGGTCTAGAGTGGGTCTCAGGT
ATTACTGAGGATGGTGATCGTACATACTACGCAGACTCCGTGAAGGGCCG
GTTCACCATCTCCCGCGACAATTCCAAGAGCTCGCTGTATCTGCAAATGA
ACAGCCTGCGTGCCGAGGACACCGCGGTATATTACTGTGCGAAAATTCGT
AATCTGCATTGGGATGTGGGGAGGCAGTTTGACTACTGGGGTCAGGGAAC
CCTGGTCACCGTCTCCAGC

BMS2h-745-9 (SEQ ID NO: 893)
GAGGTGCAGCTGTTGGAGTCTGGGGGAGGCTCGGTACAGCCTGGGGGGTC
CCTGCGTCTCTCCTGTGCAGCCTCCGGATTCACCTTTGATAATACTGAGA
TGGCTTGGGTCCGCCAGGCTCCAGGGAAGGGTCTAGAGTGGGTCTCAGGT
ATTACTGAGGATGGTAATCGTACATACTACGCAGACTCCGTGAAGGGCCG
GTTCACCATCTCCCGCGACAATTCCAAGAACACTCTGTATCTGCAAATGA
ACAGCCTGCGTGCCGAGGACACCGCGGTATATTACTGTGCGAAAATTCGT
AATCTGCATTGGGATGTGGGGAGGCAGTTTGTCTACTGGGGTCAGGGAAC
CCTGGTCACCGTCTCGAGC

BMS2h-746 (SEQ ID NO: 894)
GAGGTGCAGCTGTTGGAGTCTGGGGGAGGCTTGGTACAGCCTGGGGGGTC
CCTGCGTCTCTCCTGTGCAGCCTCCGGATTCACCTTTGGGTCGGCTGAGA
TGGGGTGGGTCCGCCAGGCTCCAGGGAAGGGTCTAGAGTGGGTCTCAGGT
ATTTCGAGGCCTGGTCAGGTTACATACTACGCAGACTCCGTGAAGGGCCG
GTTCACCATCTCCCGCGACAATTCCAAGAACACGCTGTATCTGCAAATGA
ACAGCCTGCGTGCCGAGGATACCGCGGTATATTACTGTGCGAAAATTCGT
AATCTGCATTGGGATGTGGGGAGGCAGTTTGACTACTGGGGTCAGGGAAC
CCTGGTCACCGTCTCGAGC

BMS2h-747 (SEQ ID NO: 895)
GAGGTGCAGCTGTTGGAGTCTGGGGGAGGCTTGGTACAGCCTGGGGGGTC
CCTGCGTCTCTCCTGTGCAGCCTCCGGATTCACCTTTGATGATGGTACTA
TGGGGTGGGCCCGCCAGGCTCCAGGGAAGGGTCTAGAGTGGGTCTCACTT
ATTTTGCCGTCGGGTAGTCGTACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAACATTCG
CTGACTAATCGTCCGTTTGACTACTGGGGTCAGGGAACCCTGGTCACCGT
CTCGAGC

BMS2h-748 (SEQ ID NO: 896)
GAGGTGCAGCTGTTGGAGTCTGGGGGAGGCTTGGTACAGCCTGGGGGGTC
CCTGCGTCTCTCCTGTGCAGCCTCCGGATTCACCTTTAGTAAGTATGATA
TGCGGTGGGCCCGCCAGGCTCCAGGGAAGGGTCTAGAGTGGGTCTCAGAT
ATTGATGCTGTTGGTACTCGGACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGATACCGGGG
GGGACGTTTGACTACTGGGGTCAGGGAACCCTGGTCACCGTCTCGAGC

BMS2h-749 (SEQ ID NO: 897)
GAGGTGCAGCTGTTGGAGTCTGGGGGAGGCTTGGTACAGCCTGGGGGGTC
CCTGCGTCTCTCCTGTGCAGCCTCCGGATTCACCTTTGAGATGTATGGTA
TGATGTGGGCCCGCCAGGCTCCAGGGAAGGGTCTAGAGTGGGTCTCATCT
ATTGAGGGTGCGGGTCATGCGACATACTACGCAGACTCCGTGAAGGGCCG
GTTCACCATCTCCCGCGACAATTCCAAGAACACGCTGTATCTGCAAATGA
ACAGCCTGCGTGCCGAGGACACTGCGGTATATTACTGTGCGATAGTGCTT
GGTATGTTTGACTACTGGGGTCAGGGAACCCTGGTCACCGTCTCGAGC

BMS2h-75 (SEQ ID NO: 898)
GAGGTGCAGCTGTTGGAGTCTGGGGGAGGCTTGGTACAGCCTGGGGGGTC
CCTGCGTCTCTCCTGTGCAGCCTCGGATTCACCTTTTTGCAGTATCCGA
TGGGTTGGGTCCGCCAGGCTCCAGGGAAGGGTCTAGAGTGGGTCTCAACT
ATTTCTCCTGTTGGTTTGACTACATACTACGCAGACTCCGTGAAGGGCCG
GTTCACCATCTCCCGCGACAATTCCAAGAACACGCTGTATCTGCAAATGA
ACAGCCTGCGTGCCGAGGATACCGCGGTATATTACTGTGCGAAATTGTTT

TABLE 2-continued

Human Anti-CD40L VH Domain Encoding Nucleotide Sequences

GAGGGGTCGAGGATTCAGCGTGATGTGGGTTTTGACTACTGGGGTCAGGG
AACCCTGGTCACCGTCTCGAGC

BMS2h-750 (SEQ ID NO: 899)
GAGGTGCAGCTGTTGGAGTCTGGGGGAGGCTTGGTACAGCCTGGGGGGTC
CCTGCGTCTCTCCTGTGCAGCCTCCGGATTCACCTTTGAGAAGTATCAGA
TGGGTTGGGCCCGCCAGGCTCCAGGGAAGGGTCTAGAGTGGGTCTCATCG
ATTCGGGGGTCTGGTCTTGTTACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAAGTGCAT
ACTACGCTGCATACGGAGGTGATTGGGTTTGACTACTGGGGTCAGGGAAC
CCTGGTCACCGTCTCGAGC

BMS2h-751 (SEQ ID NO: 900)
GAGGTGCAGCTGTTGGAGTCTGGGGGAGGCTTGGTACAGCCGGGGGGGTC
CCTGCGTCTCTCCTGTGCAGCCTCCGGATTCACCTTTAGTCAGTATACGA
TGTATTGGGCCCGCCAGGCTCCAGGGAAGGGTCTAGAGTGGGTCTCAGAG
ATTTCTCATAGTGGTTCTAATTACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGATATCGGGG
CTGCATTTTGACTACTGGGGTCAGGGAACCCTGGTCACCGTCTCGAGC

BMS2h-752 (SEQ ID NO: 901)
GAGGTGCAGCTGTTGGAGTCTGGGGGAGGCTTGGTACAGCCTGGGGGGTC
CCTGCGTCTCTCCTGTGCAGCCTCCGGATTCACCTTTTCGGATTATGCGA
TGGCTTGGGTCCGCCAGGCTCCAGGGAAGGGTCTGGAGTGGGTCTCACGT
ATTGGTGTGGAGGGTGGGGATACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAATTGTTG
CGGCTTTATCGTCTGGGGTTTGACTACTGGGGTCAGGGAACCCTGGTCAC
CGTCTCGAGC

BMS2h-753 (SEQ ID NO: 902)
GAGGTGCAGCTGTTGGAGTCTGGGGGAGGCTTGGTACAGCCTGGGGGGTC
CCTGCGTCTCTCCTGTGCAGCCTCCGGATTCACCTTTGCTAAGTATGATA
TGACGTGGGTCCGCCAGGCTCCAGGGAAGGGTCTAGAGTGGGTCTCAAAG
ATTAATTCTGATGGTGGTCTTACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAAGGGTTG
CATGGTAGGGGGTTTGTTATTTTTGACTACTGGGGTCAGGGAACCCTGGT
CACCGTCTCGAGC

BMS2h-754 (SEQ ID NO: 903)
GAGGTGCAGCTGTTGGAGTCTGGGGGAGGCTTGGTACAGCCTGGGGGGTC
CCTGCGTCTCTCCTGTGCAGCCTCCGGATTCACCTTTTCGCGGTATGATA
TGGTGTGGGTCCGCCAGGCTCCAGGGAAGGGTCTAGAGTGGGTCTCACGG
ATTAATTCTATGGGTCTGGCTACATACTACGCAGACTCCGTGAAGGGCCG
GTTCACCATCTCCCGCGACAATTCCAAGAACACGCTGTATCTGCAAATGA
ACAGCCTGCGTGCCGAGGATACCGCGGTATATTACTGTGCGAAAGATTAT
TCGGTTGCGCCGCATGGGTATCCTTTGGGTTTTGACTACTGGGGTCAGGG
AACCCTGGTCACCGTCTCGAGC

BMS2h-755 (SEQ ID NO: 904)
GAGGTGCAGCTGTTGGAGTCTGGGGGAGGCTTGGTACAGCCTGGGGGGTC
CCTGCGTCTCTCCTGTGCAGCCTCCGGATTCACCTTTAAGGATTATTCGA
TGATGTGGGTCCGCCAGGCTCCAGGGAAGGGTCTAGAGTGGGTCTCAACG
ATTACTGATAATGGTACGTCTACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAACATATG
TCGCTTGCTACTTATCTGCAGTTTTTTGACTACTGGGGTCAGGGAACCCT
GGTCACCGTCTCGAGC

BMS2h-756 (SEQ ID NO: 905)
GAGGTGCAGCTGTTGGAGTCTGGGGGAGGCTTGGTACAGCCTGGGGGGTC
CCTGCGTCTCTCCTGTGCAGCCTCCGGATTCACCTTTATGGAGTATGATA
TGCTTTGGGTCCGCCAGGCTCCAGGGAAGGCTCTAGAGTGGGTCTCACGT
ATTTCGTCGGATGGTCTTTGGACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAAGGGGTG
AGTGCGCTTGCTCCTTTTGATATTGGTTTTGACTACTGGGGTCAGGGAAC
CCTGGTCACCGTCTCGAGC

BMS2h-757 (SEQ ID NO: 906)
GAGGTGCAGCTGTTGGAGTCTGGGGGAGGCTTGGTACAGCCTGGGGGGTC
CCTGCGTCTCTCCTGTGCAGCCTCCGGATTCACCTTTAAGGAGTATAATA
TGGCTTGGGTCCGCCAGGCTCCAGGGAAGGGTCTGGAGTGGGTCTCAAGT
ATTAATTTTGCTGGTCGGACGACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAACTGTCT
CTTCCTTTGGATATTTTTCTTTTGACTACTGGGGTCAGGGAACCCTGGT
CACCGTCTCGAGC

BMS2h-758 (SEQ ID NO: 907)
GAGGTGCAGCTGTTGGAGTCTGGGGGAGGCTTGGTACAGCCTGGGGGGTC
CCTGCGTCTCTCCTGTGCAGCCTCCGGATTCACCTTTGGTGATTATGGTA
TGAATTGGGTCCGCCAGGCTCCAGGGAAGGGTCTGGAGTGGGTCTCACAT
ATTTCTTCTAATGGTCGTTTTACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAACTAGT
GGTTATTTTGACTACTGGGGTCAGGGAACCCTGGTCACCGTCTCGAGC

BMS2h-758-1 (SEQ ID NO: 908)
GAGGTGCAGCTGTTGGAGTCTGGGGGAGGCTTGGTACAGCCTGGGGGGTC
CCTGCGTCTCTCCTGTGCAGCCTCCGGATTCACCTTTGGTGATTATGGTA
TGAATTGGGTCCGCCAGGCTCCAGGGAAGGGTCTGGAGTGGGTCTCACAT
ATTTCTTCTAATGGTCGTTTTACATACTACGCAGACTCCGTGAAGGGCCG
GTTCACCATCTCCCGCGACAATTCCAAGAACATGCTGTATCTGCAATGA
ACAGCCTGCGTGCCGAGGACACCGCGGTATATTACTGTGCGAAACTAGT
GGTTATTATGAATACTGGGGTCAGGGAACCCTGGTCACCGTCTCGAGC

BMS2h-758-2 (SEQ ID NO: 909)
GAGGTGCAGCTGTTGGAGTCTGGGGGAGGCTTGGTACAGCCTGGGGGGTC
CCTGCGTCTCTCCTGTGCAGCCTCCGGATTCACCTTTGGTGATTATGGTA
TGAATTGGGTCCGCCAGGCTCCAGGGAAGGGTCTGGAGTGGGTCTCACAT
ATTTCTTCTAATGGTCGTTTTACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAACTAGT
GGTTATTTTGAATACTGGGGTCAGGGAACCCTGGTCACCGTCTCGAGC

BMS2h-758-3 (SEQ ID NO: 910)
GAGGTGCAGCTGTTGGAGTCTGGGGGAGGCTTGGTACAGCCTGGGGGGTC
CCTGCGTCTCTCCTGTGCAGCCTCCGGATTCACCTTTGGTGATTATGGTA
TGAATTGGGTCCGCCAGGCCCCAGGGAAGGGTCTGGAGTGGGTCTCACAT
ATTTCTTCTAATGGTCGTTTTACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAACTAGT
AGTTATTTTGAATACTGGGGTCAGGGAACCCTGGTCACCGTCTCGAGC

BMS2h-758-4 (SEQ ID NO: 911)
GAGGTGCAGCTGTTGGAGTCTGGGGGAGGCTTGGTACAGCCTGGGGGGTC
CCTGCGTCTCTCCTGTGCAGCCTCCGGGTTCACCTTTGGTGATTATGGTA
TGAATTGGGTCCGCCAGGCTCCAGGGAAGGGTCTGGAGTGGGTCTCACAT
ATTTCTTCTAATGGTCGTTTTACATACTACGCAGACTCCGTGAAGGGCCG
GTTCACCATCTCCCGCGACAATTCCAAGAACACGCTGTTTCTGCAAATGA
ACAGCCTGCGTGCCGAGGACACCGCGGTATATTACTGTGCGGAAACTAGT
GGTTATTATGAGTACTGGGGTCATGGAACCCTGGTCACCGTCTCGAGC

BMS2h-758-5 (SEQ ID NO: 912)
GAGGTGCAGCTGTTGGAGTCTGGGGGAGGCTTGGTCCAGCCTGGGGGGTC
CCTGCGTCTCTCCTGTGCTGCCTCCGGATTCGCCTTTGGTGATTATGGTA
TGAATTGGGTCCGCCAGGCTCCAGGGAAGGGTCTGGAGTGGGTCTCACAT
ATTTCTTCTAATGGTCGTTTTACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAACTAGT
GGTTATTTTGAATACTGGGGTCAGGGAACCCTGGTCACCGTCTCGAGC

BMS2h-758-6 (SEQ ID NO: 913)
GAGGTGCAGCTGTTGGAGTCTGGGGGAGGCTTGGTACAGCCTGGGGGGTC
CCTGCGTCTCTCCTGTGCAGCCTCCGGATTCACCTTTGGTGATTATGGTA
TGAATTGGGTCCGCCAGGCTCCAGGGAAGGGTCTGGAGTGGGTCTCACAT
ATTTCTTCTAATGGTCGTTTATACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAACTAGT
GGTTACTTTGAATACTGGGGTCAGGGAACCCTGGTCACCGTCTCGAGC

BMS2h-759 (SEQ ID NO: 914)
GAGGTGCAGCTGTTGGAGTCTGGGGGAGGCTTGGTACAGCCTGGGGGGTC
CCTGCGTCTCTCCTGTGCAGCCTCCGGATTCACCTTTAGGGAGTATGTTA
TGGGGTGGGTCCGCCAGGCTCCAGGGAAGGGTCTAGAGTGGGTCTCAACT
ATTAATGGTTTGGGTAATGTTACATACTACGCAGACTCCGTGAAGGGCCG
GTTCACCATCTCCCGCGACAATACCAAGAACACGCTGTATCTGCAAATGA
ACAGCCTGCGTGCCGAGGAGACCGCGGTATATTACTGTGCGATACAGCTG
CCTAATTTTGACTACTGGGGTCAGGGAACCCTGGTCACCGTCTCGAGC

TABLE 2-continued

Human Anti-CD40L VH Domain Encoding Nucleotide Sequences

BMS2h-760 (SEQ ID NO: 915)
GAGGTGCAGCTGTTGGAGTCTGGGGGAGGCTTGGTACAGCCTGGGGGGTC
CCTGCGTCTCTCCTGTGCAGCCTCCGGATTCACCTTTGGTAATGATGGGA
TGTGGTGGGTCCGCCAGGCTCCAGGGAAGGGTCTAGAGTGGGTCTCATTT
ATTAATGTTGATGGTAGGGAGACATACTACGCAGACTCCGTGAAGGGCCG
GTTCACCATCTCCCGCGACAATTCCAAGAACACGCTGTATCTGCAAATGA
ACAGCCTGCGTGCCGAGGATACCGCGGTATATTACTGTGCGGAATGGTCT
CCTGGGCGGGTTCAGTTTGACTACTGGGGTCAGGGAACCCTGGTCACCGT
CTCGAGC

BMS2h-761 (SEQ ID NO: 916)
GAGGTGCAGCTGTTGGAGTCTGGGGGAGGCTTGGTACAGCCTGGGGGGTC
CCTGCGTCTCTCCTGTGCAGCCTCCGGATTCACCTTTGGTGGTTGGGATA
TGGCGTGGGTCCGCCAGGCTCCAGGGAAGGGTCTAGAGTGGGTCTCAAGT
ATTGCTCATGAGGGTGGTGAGACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAATATGTT
CCTGGGTCTTCCTCTGTTTGACTACTGGGGTCAGAGAACCCTGGTCACCGT
CTCGAGC

BMS2h-762 (SEQ ID NO: 917)
GAGGTGCAGCTGTTGGAGTCTGGGGGAGGCTTGGTACAGCCTGGGGGGTC
CCTGCGTCTCTCCTGTGCAGCCTCCGGATTCACCTTTGATCAGGGTTGGA
TGTATTGGGTCCGCCAGGCTCCAGGGAAGGGTCTAGAGTGGGTCTCAGGG
ATTGGTTCGAATGGTCCTCGGACATCCTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAATCGGGG
GAGTATTTTGACTACTGGGGTCAGGGAACCCTGGTCACCGTCTCGAGC

BMS2h-763 (SEQ ID NO: 918)
GAGGTGCAGCTGTTGGAGTCTGGGGGAGGCTTGGTACAGCCTGGGGGGTC
CCTGCGTCTCTCCTGTGCAGCCTCCGGATTCACCTTTAGGCAGAGTGATA
TGTGGTGGGTCCGCCAGGCTCCAGGGAAGGGTCTAGAGTGGGTCTCAGTT
ATTGGTAATAATGGTGAGTTTACATACTACGCAGACTCGGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAAGATAAT
TGGCTGTTGTTTGACTACTGGGGTCAGGGAACCCTGGTCACCGTCTCG
AGC

BMS2h-764 (SEQ ID NO: 919)
GAGGTGCAGCTGTTGGAGTCTGGGGGAGGCTTGGTACAGCCTGGGGGGTC
CCTGCGTCTCTCCTGTGCAGCCTCCGGATTCACCTTTGATCTTAGTACTA
TGTATTGGGTCCGCCAGGCTCCAGGGAAGGGTCTAGAGTGGGTCTCAACT
ATTGGTGGGATGGTAGTCATACATACTACGCAGACTCCGTGAAGGGCCG
GTTCACCATCTCCCGCGACAATTCCAAGAACACGCTGTATCTGCAAATGA
ACAGCCTGCGTGCCGAGGATACCGCGGTATATTACTGTGCGGAAGGTACG
CAGTATTTTGACTACTGGGGTCAGGGAACCCTGGTCACCGTCTCGAGC

BMS2h-765 (SEQ ID NO: 920)
GAGGTGCAGCTGTTGGAGTCTGGGGGAGGCTTGGTACAGCCTGGGGGGTC
CCTGCGTCTCTCCTGTGCAGCCTCCGGATTCACCTTTTCGGCGTATACGA
TGGAGTGGGTCCGCCAGGCTCCAGGGAAGGGTCTAGAGTGGGTCTCAAGT
ATTGGGGTTACGGGTTATGATACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAAGGTGGT
CAGGGTTTTGACTACTGGGGTCAGGGAACCCTGGTCACCGTCTCGAGC

BMS2h-766 (SEQ ID NO: 921)
GAGGTGCAGCTGTTGGAGTCTGGGGGAGGCTTGGTACAGCCTGGGGGGTC
CCTGCGTCTCTCCTGTGCAGCCTCCGGATTCACCTTTGGGGATTATGGGA
TGTCTTGGGTCCGCCAGGCTCCAGGGAAGGGTCTAGAGTGGGTCTCATAT
ATTGATCCTCTGGGTCGTCTTACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGGAAGATTTG
TCGTCGCTGCAGTATGGGGTGTCGCCTAATTTTGACTACTGGGGTCAGGG
AACCCTGGTCACCGTCTCGAGC

BMS2h-767 (SEQ ID NO: 922)
GAGGTGCAGCTGTTGGAGTCTGGGGGAGGCTTGGTACAGCCTGGGGGGTC
CCTGCGTCTCTCCTGTGCAGCCTCCGGATTCACCTTTTTTTCATTATTCTA
TGAGTTGGGTCCGCCAGGCTCCAGGGAAGGGTCTAGAGTGGGTCTCATCT
ATTAGTCCGGTTGGTCGGGAGACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAAATGATT
CAGTCGCCGTTGTTTAAGGATTTTGACTACTGGGGTCAGGGAACCCTGGT
CACCGTCTCGAGC

BMS2h-768 (SEQ ID NO: 923)
GAGGTGCAGCTGTTGGAGTCTGGGGGAGGCTTGGTACAGCCTGGGGGGTC
CCTGCGTCTCTCCTGTGCAGCCTCCGGATTCACCTTTGAGTGGTATGATA
TGTATTGGGTCCGCCAGGCTCCAGGGAAGGGTCTAGAGTGGGTCTCACGT
ATTGATAGTGGGGGTAATCAGACATACTACGCAGACTCCGTGAAGGGCCG
GTTCACCATCTCCCGCGACAATTCCAAGAACACGCTGTATCTGCAAATGA
ATAGCCTGCGTGCCGAGGACACCGCGGTATATTACTGTGCGGAAGCGTCG
CTTTGGAAGTGGAGGTTGTTTGACTACTGGGGTCAGGGAACCCTGGTCAC
CGTCTCGAGC

BMS2h-77 (SEQ ID NO: 924)
GAGGTGCAGCTGTTGGAGTCTGGGGGAGGCTTGGTACAGCCTGGGGGGTC
CCTGCGTCTCTCCTGTGCAGCCTCCGGATTCACCTTTGAGGAGTATGGTA
TGGCGTGGGTCCGCCAGGCTCCAGGGAAGGGTCTAGAGTGGGTCTCAACT
ATTTCTCCGCTGGGTATTTCGACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAACATGCT
ACGTCTCAGGAGTCTTTGCGGTCTTTTGACTACTGGGGTCAGGGAACCCT
GGTCACCGTCTCGAGC

BMS2h-770 (SEQ ID NO: 925)
GAGGTGCAGCTGTTGGAGTCTGGGGGAGGCTTGGTACAGCCTGGGGGGTC
CCTGCGTCTCTCCTGTGCAGCCTCCGGATTCACCTTTAGTAAGTATGAGA
TGATGTGGGTCCGCCAGGCTCCAGGGAAGGGTCTAGAGTGGGTCTCAGCT
ATTAGTGGTAGTGGTGGTAGCACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAAGGTCCT
CTGCCTGATGCGTTTTGGACTAGGGGTTTTGACTACTGGGGTCAGGGAAC
CCTGGTCACCGTCTCGAGC

BMS2h-771 (SEQ ID NO: 926)
GAGGTGCAGCTGTTGGAGTCTGGGGGAGGCTTGGTACAGCCTGGGGGGTC
CCTGCGTCTCTCCTGTGCAGCCTCCGGATTCACCTTTGGTACTTATTCTA
TGGCGTGGGTCCGCCAGGCTCCAGGGAAGGGTCTAGAGTGGGTCTCAACT
ATTGATCGGCATGGTTTGGCTACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAAACTCCT
GGTTCTTCTTGGCAGACTGTTTTTGGCTACTGGGGTCAGGGAACCCTGGT
CACCGTCTCGAGC

BMS2h-772 (SEQ ID NO: 927)
GAGGTGCAGCTGTTGGAGTCTGGGGGAGGCTTGGTACAGCCTGGGGGGTC
CCTGCGTCTCTCCTGTGCAGCCTCCGGATTCACCTTTGAGTGGTATCCTA
TGGGTTGGGTCCGCCAGGCTCCAGGGAAGGGTCTAGAGTGGGTCTCAAGT
ATTGATCATCATGGTCATTCGACATACTACGCAGACTCCGCGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAATTGCTT
AGGGTTTCGATGATTTTTGGTTTTGACTACTGGGGTCAGGGAACCCTGGT
CACCGTCTCGAGC

BMS2h-773 (SEQ ID NO: 928)
GAGGTGCAGCTGTTGGAGTCTGGGGGAGGCTTGGTACAGCCTGGGGGGTC
CCTGCGTCTCTCCTGTGCAGCCTCCGGATTCACCTTTGTGCAGTATGGGA
TGAGTTGGGTCCGCCAGGCTCCAGGGAAGGGTCTAGAGTGGGTCTCATGG
ATTAGTAGTAGTGGTACGTATACATACTACGCAGACTCCGTGAAGGGCCG
GTTCACCATCTCCCGCGACAATTCCAAGAACACGCTGTATCTGCAAATGA
ACAGCCTACGTGCCGAGGACACCGCGGTATATTACTGTGCGGAAACGTCT
AGGATGTTTGACTACTGGGGTCAGGGAACCCTGGTCACCGTCTCGAGC

BMS2h-774 (SEQ ID NO: 929)
GAGGTGCAGCTGTTGGAGTCTGGGGGAGGCTTGGTACAGCCTGGGGGGTC
CCTGCGTCTCTCCTGTGCAGCCTCCGGATTCACCTTTCGGGAGTATGATA
TGGGTTGGGTCCGCCAGGCTCCAGGGAAGGGTCTAGAGTGGGTCTCACTT
ATTTCGCCTCCTGGTCGTACTACATACTACGCAGACTCCGTGAAGGGCCG
GTTCACCATCTCCCGCGACAATTCCAAGAACACGCTGTATCTGCAAATGA
ACAGCCTGCGTGCCGAGGATACCGCGGTATATTACTGTGCGAAAGTTGTG
ATTCTGGGTTATACGAATAGGTTTGACTACTGGGGTCAGGGAACCCTGGT
CACCGTCTCGAGC

BMS2h-775 (SEQ ID NO: 930)
GAGGTGCAGCTGTTGGAGTCTGGGGGAGGCTTGGTACAGCCTGGGGGGTC
CCTGCGTCTCTCCTGTGCAGCCTCCGGATTCACCTTTCCTAATTACGGGA
TGTTGTGGGTCCGCCAGGCTCCAGGGAAGGGTCTAGAGTGGGTCTCATCG
ATTAATTCTTCGGGTATGGAGACATACTACGCAGACTCCGTGAAGGGCCG
GTTCACCATCTCCCGCGACAATTCCAAGAACACGCTGTATCTGCAAATGA
ACAGCCTGCGTGCCGAGGATACCGCGGTATATTACTGTGCGAAATTTTTT

TABLE 2-continued

Human Anti-CD40L VH Domain Encoding Nucleotide Sequences

CGTCTGAATGATCATAATTCTGTGTTTGGTTTTGACTACTGGGGTCAGGG
AACCCTGGTCACCGTCTCGAGC

BMS2h-776 (SEQ ID NO: 931)
GAGGTGCAGCTGTTGGAGTCTGGGGGAGGCTTGGTACAGCCTGGGGGGTC
CCTGCGTCTCTCCTGTGCAGCCTCCGGATTCACCTTTAAGGATTATAAGA
TGATGTGGATCCGCCAGGCTCCAGGGAAGGGTCTAGAGTGGGTCTCATCG
ATTGTTGGGTCTGGTTCGATGACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAAGGGCCT
GGTTATTTTGACTACTGGGGTCAGGGAACCCTGGTCACCGTCTCGAGC

BMS2h-777 (SEQ ID NO: 932)
GAGGTGCAGCTGTTGGAGTCTGGGGGAGGCTTGGTACAGCCTGGGGGGTC
CCTGCGTCTCTCCTGTGCAGCCTCCGGATTCACCTTTCATAATTATGCTA
TGGGGTGGGTCCGCCGGGCTCCAGGGAAGGGTCTAGAGTGGGTCTCAAGT
ATTGATGAGCATGGTACTATTACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAAGATAGT
CTGGATCGGGTTTGGATTTTTGACTACTGGGGTCAGGGAACCCTGGTCAC
CGTCTCGAGC

BMS2h-778 (SEQ ID NO: 933)
GAGGTGCAGCTGTTGGAGTCTGGGGGGGGCTTGGTACAGCCTGGGGGGTC
CCTGCGTCTCTCCTGTGCAGCCTCCGGATTCACCTTTGCTGATTATCCGA
TGACTTGGGTCCGCCAGGCTCCAGGGAAGGGTCTAGAGTGGGTCTCAAGT
ATTTATTCTGCGGGTTCTCCTACATACTACGCAGACTCCGTGAAGGGCCG
GTTCACCATCTCCCGCGACAATTCCAAGAACACGCTGTATCTGCAAATGA
ACAGCCTGCGTGCCGAGGATACCGCGGTATATTACTGTGCGAAACTTTAT
CATCGGGAGCCGATTCTTTTTGGGTTTGACTACTGGGGTCAGGGAACCCT
GGTCACCGTCTCGAGC

BMS2h-78 (SEQ ID NO: 934)
GAGGTGCAGCTGTTGGAGTCTGGGGGAGGCTTGGTACAGCCTGGGGGGTC
CCTGCGTCTCTCCTGTGCAGCCTCCGGATTCACCTTTGAGAGGTATCAGA
TGGCGTGGGTCCGCCAGGCTCCGGGGAAGGGTCTAGAGTGGGTCTCAACG
ATTAGTTCTGATGGTGGGGGACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAACCTGGT
CATCGGTTTGACTACTGGGGTCAGGGAACCCTGGTCACCGTCTCGAGC

BMS2h-780 (SEQ ID NO: 935)
GAGGTGCAGCTGTTGGAGTCTGGGGGAGGCTTGGTACAGCCTGGGGGGTC
CCTGCGTCTCTCCTGTGCAGCCTCCGGATTCACCTTTGGTTCTTATACTA
TGATGTGGGTCCGCCAGGCTCCAGGGAAGGGTCTAGAGTGGGTCTCAGAG
ATTGATCGGACGGGTGAGCGTACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGGAACCTGGG
TTTGCTTCTCTTCCTTTTGACTACTGGGGTCAGGGAACCCTGGTCACCGT
CTCGAGC

BMS2h-781 (SEQ ID NO: 936)
GAGGTGCAGCTGTTGGAGTCTGGGGGAGGCTTGGTACAGCCTGGGGGGTC
CCTGCGTCTCTCCTGTGCAGCCTCCGGATTCACCTTTACGGATTATACTA
TGTATTGGGTCCGCCAGGCTCCAGGGAAGGGTCTAGAGTGGGTCTCAAAG
ATTTCTCCGAGTGGTCGTTCTACATACTACGCAGACTCCGTGAAGGGCCG
GTTCACCATCTCCCGCGACAATTCCAAGAACACGCTGTATCTGCAAATGA
ACAGCCTGCGTGCCGAGGATACCGCGGTATATTACTGTGCGAAAGATCCG
TTTGGGTTTGACTACTGGGGTCAGGGAACCCTGGTCACCGTCTCGAGC

BMS2h-782 (SEQ ID NO: 937)
GAGGTGCAGCTGTTGGAGTCTGGGGGAGGCTTGGTACAGCCTGGGGGGTC
CCTGCGTCTCTCCTGTGCAGCCTCCGGATTCACCTTTGATGATCGGAGA
TGTTTTGGGTCCGCCAGGCTCCAGGGAAGGGTCTAGAGTGGGTCTCATCT
ATTGATGCTCGTGGTTTGACGACATACTACGCAGACCCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGGAAGCGACG
TCGGCTATGTATCCTTTTGACTACTGGGGTCAGGGAACCCTGGTCACCGT
CTCGAGC

BMS2h-783 (SEQ ID NO: 938)
GAGGTGCAGCTGTTGGAGTCTGGGGGAGGCTTGGTACAGCCTGGGGGGTC
CCTGCGTCTCTCCTGTGCAGCCTCCGGATTCACCTTTCGTGATTATGATA
TGGGTTGGGTCCGCCAGGCTCCAGGGAAGGGTCTAGAGTGGGTCTCAACT
ATTTCTCCTCTTGGTCATTTTACATACTACGCAGACTCCGTGAAGGGCCG
GTTCACCATCTCCCGCGACAATTCCAAGAACACGCTGTATCTGCAAATGA
ACAGCCTGCGTGCCGAGGATACCGCGGTATATTACTGTGCGAAATCTGGG

TTTCATGAGTATACTGAGGGGTTTGACTACTGGGGTCAGGGAACCCTGGT
CACCGTCTCGAGC

BMS2h-784 (SEQ ID NO: 939)
GAGGTGCAGCTGTTGGAGTCTGGGGGAGGCTTGGTACAGCCTGGGGGGTC
CCTGCGTCTCTCCTGTGCAGCCTCCGGATTCACCTTTGATCGTGCGGGTA
TGGGGTGGGTCCGCCAGGCTCCAGGGAAGGGTCTAGAGTGGGTCTCACTG
ATTGGGCGTGGTGGTGATATTACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAAATTCGT
AATCTGCATTGGGATGTGGGGAGGCAGTTTGACTACTGGGGTCAGGGAAC
CCTGGTCACCGTCTCGAGC

BMS2h-80 (SEQ ID NO: 940)
GAGGTGCAGCTGTTGGAGTCTGGGGGAGGCTTGGTACAGCCTGGGGGGTC
CCTGCGTCTCTCCTGTGCAGCCTCCGGATTCACCTTTGGTCGTTATCAGA
TGGCTTGGGTCCGCCAGGCTCCAGGGAAGGGTCTAGAGTGGGTCTCATCT
ATTTCTTCTGATGGGGGGACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAACCGTCT
CGTCGGTTTGACTACTGGGGTCAGGGAACCCTGGTCACCGTCTCGAGC

BMS2h-81 (SEQ ID NO: 941)
GAGGTGCAGCTGTTGGAGTCTGGGGGAGGCTTGGTACAGCCTGGGGGGTT
CCTGCGTCTCTCCTGTGCAGCCTCCGGATTCACCTTTGAGTTGTATCCGA
TGGGCTGGGTCCGCCAGGCTCCAGGGAAGGGTCTGGAGTGGGTCTCATCG
ATTTCTCCGGTTGGTTTTCTGACATACTACGCAGACTCCGTGAAGGGCCG
GTTCACCATCTCCCGCGACAATTCCAAGAACACGCTGTATCTGCAAATGA
ACAGCCTGCGTGCCGAGGATACCGCGGTATATTACTGTGCGAAAGGGCAT
GAGGGGTCGTATACTCCGCGGTCGGTTTTGACTACTGGGGTCAGGGAAC
CCTGGTCACCGTCTCGAGC

BMS2h-82 (SEQ ID NO: 942)
GAGGTGCAGCTGTTGGAGTCTGGGGGAGGCTTGGTACAGCCTGGGGGGTC
CCTGCGTCTCTCCTGTGCAGCCTCCGGATTCACCTTTGTGGCGTATCCTA
TGGCTTGGGTCCGCCAGGCTCCAGGGAAGGGTCTGGAGTGGGTCTCAACT
ATTGCGCCTCTGGGTGGTAATACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAACGGCCG
GAGGGGTGCAGATTGATTCTCAGAATTTTGACTACTGGGGTCAGGGAAC
CCTGGTCACCGTCTCGAGC

BMS2h-83 (SEQ ID NO: 943)
GAGGTGCAGCTGTTGGAGTCTGGGGGAGGCTTGGTACAGCCTGGGGGGTC
CCTGCGTCTCTCCTGTGCAGCCTCCGGATTCACCTTTGCGTTGTATCAGA
TGGCTTGGGTCCGCCAGGCTCCAGGGAAGGGTCTAGAGTGGGTCTCATCG
ATTGATTCTTGGTAGTGATACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAACCTGAG
CGTGATTTTGACTACTGGGGTCAGGGAACCCTGGTCACCGTCTCGAGC

BMS2h-84 (SEQ ID NO: 944)
GAGGTGCAGCTGTTGGAGTCTGGGGGAGGCTTGGTACAGCCTGGGGGGTC
CCTGCGTCTCTCCTGTGCAGCCTCCGGATTCACCTTTAGGCAGTACCAGA
TGGCTTGGGCCCGCCAGGCTCCAGGGAAGGGTCTAGAGTGGGTCTCAACG
ATTGCTCGGATGGTGTTTACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAAGTTGGT
CGTGATTTTGACTACTGGGGTCAGGGAACCCTGGTCACCGTCTCGAGC

BMS2h-85 (SEQ ID NO: 945)
GAGGTGCAGCTGTTGGAGTCTGGGGGAGGCTTGGTACAGCCTGGGGGGTC
CCTGCGTCTCTCCTGTGCAGCCTCCGGATTCACCTTTGAGCAGTATGATA
TGAGGTGGGTCCGCCAGGCTCCAGGGAAGGGTCTAGAGTGGGTCTCATGG
ATTGATGAGCGGGTCATGAGACATATATGCAGACTCCGTGAAGGGCCG
GTTCACCATCTCCCGCGACAATTCCAGGAACACGCTGTATCTGCAAATGA
ACAGCCTGCGTGCCGAGGACACCGCGGTATATTACTGTGCGAAAGGGATG
GATGGGTTTGACTACTGGGGTCAGGGAACCCTGGTCACCGTCTCGAGC

BMS2h-92 (SEQ ID NO: 946)
GAGGTGCAGCTGTTGGAGTCTGGGGGAGGCTTGGTACAGCCTGGGGGGTC
CCTGCGTCTCTCCTGTGCAGCCTCCGGATTCACCTTTGTTGATTATCCGA
TGGGTTGGGTCCGCCAGGCTCCAGGGAAGGGTCTAGAGTGGGTCTCAACG
ATTTCTACGGGGGGTTTTCGACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAAGCGCGG

TABLE 2-continued

Human Anti-CD40L VH Domain Encoding Nucleotide Sequences

TATTATTATCTTAGTCAGATTAAGAATTTTGACTACTGGGGTCAGGGAAC
CCTGGTCACCGTCTCGAGC

BMS2h-93 (SEQ ID NO: 947)
GAGGTGCAGCTGTTGGAGTCTGGGGGAGGCTTGGTACAGCCTGGGGGGTC
CCTGCGTCTCTCCTGTGCAGCCTCCGGATTCACCTTTGATATTTATGGGA
TGACTTGGGTCCGCCAGGCTCCAGGGAAGGGTCTGGAGTGGGTCTCAAGT
ATTTCGCCTCTTGGTCTTGTTACATACTACGCAGACCCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAACTGAAG
GAGCATGGGGATGTTCCTTTTGACTACTGGGGTCAGGGAACCCTGGTCAC
CGTCTCGAGC

BMS2h-94 (SEQ ID NO: 948)
GAGGTGCAGCTGTTGGAGTCTGGGGGAGGCTTGGTACAGCCTGGGGGGTC
CCTGCGTCTCTCCTGTGCAGCCTCCGGATTCACCTTTGAGCTTTATCCGA
TGAGTTGGGTCCGCCAGGCTCCAGGGAAGGGTCTAGAGTGGGTCTCAACT
ATTTCTCCTACGGGTTTGTTGACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAATTTAAG
AGGAGTGGGAAGACTGATGATACTAATTTTGACTACTGGGGTCAGGGAAC
CCTGGTCACCGTCTCGAGC

BMS2h-95 (SEQ ID NO: 949)
GAGGTGCAGCTGTTGGAGTCTGGGGGAGGCTTGGTACAGCCTGGGGGGTC
CCTGCGTCTCTCCTGTGCAGCCTCCGGATTCACCTTTGATATGATA
TGCTGTGGGTCCGCCAGGCTCCAGGGAAGGGTCTAGAGTGGGTCTCAACG
ATTGTGGGGATGGTAATGGTACATACTACGCAGACTCCGTGAAGGGCCG
GTTCACCATCTCCCGCGACAATTCCAAGAACACGCTGTATCTGCAAATGA
ACAGCCTGCGTGCCGAGGACACCGCGGTATATTACTGTGCGAAACAGGAT
CGTCAGTTTGACTACTGGGGTCAGGGAACCCTGGTCACCGTCTCGAGC

BMS2h-97 (SEQ ID NO: 950)
GAGGTGCAGCTGTTGGAGTCTGGGGGAGGCTTGGTACAGCCTGGGGGGTC
CCTGCGTCTCTCCTGTGCAGCCTCCGGATTCACCTTTGAGGAGTATGGTA
TGAGTTGGGTCCGCCAGGCTCCAGGGAAGGGTCTAGAGTGGGTCTCAACG
ATTTCGCCTATTGGTGTTACTACATACTACGCAGACTCCGTGAAGGGCCG
GTTCACCATCTCCCGCGACAATTCCAAGAACACGCTGTATCTGCAAATGA
ACAGCCTGCGTGCCGAGGATACCGCGGTATATTACTGTGCGAAAATGCT
TATGATCGGAAGTCTAATTTTGACTACTGGGGTCAGGGAACCCTGGTCAC
CGTCTCGAGC

BMS2h-98 (SEQ ID NO: 951)
GAGGTGCAGCTGTTGGAGTCTGGGGGAGGCTTGGTACAGCCTGGGGGGTC
CCTGCGTCTCTCCTGTGCAGCCTCCGGATTCACCTTTGATCGGTATGTGA
TGGTGTGGGTCCGCCAGGCTCCAGGGAAGGATCTAGAGTGGGTCTCAGGT
ATTACTCCGAGTGGTAGGAGGACATACTACGCAGACTCCGTGAAGGGCCG
GTTCACCATCTCCCGCGACAATTCCAAGGACACGCTGTATCTGCAAATGA
ACAGCCTGCGTGCCGAGGACACCGCGGTATATTACTGTGCGAAAGTGTTG
GGGCGTCATTTTGATCCTCTTCTGCCTTCGTTTGACTACTGGGGTCAGGG
AACCCTGGTCACCGTCTCGAGC

BMS2h-99 (SEQ ID NO: 952)
GAGGTGCAGCTGTTGGAGTCTGGGGGAGGCTTGGTACAGCCTGGGGGGTC
CCTGCGTCTCTCCTGTGCAGCCTCCGGATTCACCTTTGAGGATTATGCTA
TGAGTTGGGTCCGCCAGGCTCCAGGGAAGGGTCTAGAGTGGGTCTCAACT
ATTACTCCGGGTGGTTTTTGGACATACTACGCAGACTCCGTGAAGGGCCG
GTTCACCATCTCCCGCGACAATTCCAAGAACACGCTGTATCTGCAAATGA
ACAGCCTGCGTGCCGAGGATACCGCGGTATATTACTGTGCGAAAACGTCT
AGTGGGGAGTTGCAGTTGGTTGAGGATTTTGACTACTGGGGTCAGGGAAC
CCTGGTCACCGTCTCGAGC

TABLE 3

Anti-human CD40L VK Domain Amino Acid Sequences

BMS2h-100 (SEQ ID NO: 953)
DIQMTQSPSS LSASVGDRVT ITCRASQNIK HSLRWYQQKP
GKAPRLLIYH RSQLQSGVPS RFSGSGSGTD FTLTISSLQP
EDFATYYCQQ VRHRPYTFGQ GTKVEIKR

BMS2h-101 (SEQ ID NO: 954)
DIQMTQSPSS LSASVGDRVT ITCRASQAIG HRLRWYQQKP
GKAPKLLIYH RSKLQSGVPS RFSGSGSGTD FTLTISSLQP
EDFATYYCQQ VALFPYTFGQ GTKVEIKR

BMS2h-102 (SEQ ID NO: 955)
DIQMTQSPSS LSASVGDRVT ITCRASQHIG HHLRWYQQKP
GKAPKLLIYH RSHLQSGVPS RFSGSGSGTD FTLTISSLQP
EDSATYYCQQ WDRPPYTFGQ GTKVEIKR

BMS2h-103 (SEQ ID NO: 956)
DIQMTQSPSS LSASVGDRVT ITCRASQAIG HRLRWYQQKP
GKAPKLLIYH RSKLQSGVPS RFSGSGSGTD FTLTISSLQP
EDFATYYCQQ VRAVPYTFGQ GTKVEIKR

BMS2h-104 (SEQ ID NO: 957)
DIQMTQSPSS LSASVGDRVT ITCRASQAIG HRLRWYQQKP
GKAPKLLIYH RSKLQSGVPS RFSGSGSGTD FTLTISSLQP
EDFATYYCQQ VRFSPYTFGQ GTKVEIKR

BMS2h-105 (SEQ ID NO: 958)
DIQMTQSPSS LSASVGDRVT ITCRASQAIG HRLRWYQQKP
GKAPKLLIYH RSKLQSGVPS RFSGSGSGTD FTLTISSLQP
EDFATYYCQQ SYARPVTFGQ GTKVEIKR

BMS2h-106 (SEQ ID NO: 959)
DIQMTQSPSS LSASVGDRVT ITCRASQSIN HRLYWYQQKP
GKAPKLLIYH RSRLQSGVPS RFSGSGSGTD FTLTISSLQP
EDFATYYCQQ YKVRPNTFGQ GTKVEIKR

BMS2h-107 (SEQ ID NO: 960)
DIQMTQSPSS LSASVGDRVT ITCRASQAIG HRLRWYQQKP
GKAPKLLIYH RSKLQSGVPS RFSGSGSGTD FTLTISSLQP
EDFATYYCQQ TYSSPHTFGQ GTKVEIKR

BMS2h-108 (SEQ ID NO: 961)
DIQMTQSPSS LSASVGDRVT ITCRASQAIG HRLRWYQQKP
GKAPKLLIYH RSKLQSGVPS RFSGSGSGTD FTLTISSLQP
EDFATYYCQQ RAVRPFTFGQ GTKVEIKR

BMS2h-109 (SEQ ID NO: 962)
DIQMTQSPSS LSASVGDRVT ITCRASQAIG HRLRWYQQKP
GKAPKLLIYH RSKLQSGVPS RFSGSGSGTD FTLTISSLQP
EDFATYYCQQ TYYRPLTFGQ GTKVEIKR

BMS2h-110 (SEQ ID NO: 963)
DIQMTQSPAS LSASVGDRVT ITCRASQDID PMLRWYQQKP
GKAPKLLIYA GSILQSGVPS RFSGSGSGTD FTLTISSLQP
EDFATYYCQQ TSIRPYTFGQ GTKVEIKR

BMS2h-116 (SEQ ID NO: 964)
DIQMTQSPSS LSASVGDRVT ITCRASQPIG PDLLWYQQKP
GKAPKLLIYQ TSILQSGVPS RFSGSGSGTD FTLTISSLQP
EDFATYYCQQ YWAFPVTFGQ GTKVEIKR

BMS2h-116-1 (SEQ ID NO: 965)
DIQMTQSPSS LSASVGDRVT ITCRASQPIG PDILWYQQKP
GKAPKLLIYQ TSILQSGVPS RFSGSESGTD FTLTISSLQP
EDFATYYCQQ YWAFPVTFGQ GTKVEIKR

BMS2h-116-10 (SEQ ID NO: 966)
DIQITQSPSS LSASVGDRVT ITCRASQPIG PDLLWYQQKP
GKAPKLLIYQ TSILRSGVPS RFSGSGSGTD FTLTISSLQP
EDLATYYCQQ YWAFPVTFGQ GTKVEIKR

BMS2h-116-11 (SEQ ID NO: 967)
DIQMTQSPSS LSASVGDRVT ITCRASQPIG PDLLWYQQKP
GKAPKLLIYQ TSILRSGVPS RFSGRGSGTD FTLTISSLQP
EDFATYYCQQ YWAFPVTFGQ GTKVEIKR

BMS2h-116-12 (SEQ ID NO: 968)
DIQMTQSPSS LSASVGDRVT ITCRASQPIG PDLLWYQQKP
GKAPKLLIYQ TSILRSGVPS RFSGSGSGTD FTLTISSLQP
EDFATYYCQQ YWTFPVTFGQ GTKVEIKR

BMS2h-116-13 (SEQ ID NO: 969)
DIQMTQSPSS LSASVGDRVT ITCRASQPIG PDLLWYQQKP
GKAPKLLIYQ TSILRSGVPS RFSGSGSETD FTLTISNLQP
EDFATYYCQQ YWAFPVTFGQ GTKVVIKR

BMS2h-116-1312 (SEQ ID NO: 970)
DIQMTQSPSS LSASVGDRVT ITCRASQPIG PDLLWYQQKP

TABLE 3-continued

Anti-human CD40L VK Domain Amino Acid Sequences

GKAPKLLIYQ TSILRSGVPS RFSGSGSETD FTLTISNLQP
EDLATYYCQQ YWAFPVTFGK GTKVVIKR

BMS2h-116-1313 (SEQ ID NO: 971)
DIQMTQSPSS LSASVGDRVT ITCRASQPIG PDLLWYQQKP
GKAPKLLIYQ TSILRSGVPS RFSGSGSETD FTLTISNLQP
EDFATYYCQQ YWAFPVTFGR GTKVVIKR

BMS2h-116-1314 (SEQ ID NO: 972)
DIQMTQSPSS LSASVGDRVT ITCRASQPIG PDLLWYRQKP
GKAPKLLIYQ TSILRSGVPS RFSGSGSETD FTLTISNLQP
EDFATYYCQQ YWAFPVTFGQ GTKVVIKR

BMS2h-116-1319 (SEQ ID NO: 973)
DIQMTQSPSS LSASVGDRVT ITCRASQPIG PDLLWYQQKP
GKAPKLLIYQ TSIMRSGVPS RFSGSGSETD FTLTISNLQP
EDFATYYCQQ YWTFPVTFGQ GTKVEIKR

BMS2h-116-1320 (SEQ ID NO: 974)
DIQMTQSPSS LSAYVGDRVT ITCRASQPIG PDLLWYQQKP
GKAPKLLIYQ TSILRSGVPS RFSGSGSETD FTLTISNLQP
EDFAKYYCQQ YWAFPVTFGQ GTKVVIKR

BMS2h-116-138 (SEQ ID NO: 975)
DIQMTQSPSS LSASVGDRVT ITCRASQPIG PDLLWYQQKP
GKAPKLLIYQ TSILRSGVPS RFSGSGSETD FTLTISNLQP
VDFATYYCQQ YWAFPVTFGQ GTKVVIKR

BMS2h-116-14 (SEQ ID NO: 976)
DIQMTQSPSS LSASVGDRVT ITCRASQPIG PDLLWFQQKP
GKAPKLLIYQ TSILQSGVPS RFSGSESGTD FTLTISSLQP
EDFATYYCQQ YWAFPVTFGQ GTKVEIKR

BMS2h-116-15 (SEQ ID NO: 977)
DIQMTQSPSS LSASVGDRVT ITCRASQPIG PDLLWYRQKP
GKAPKLLIYQ TSILQSGVPS RFSGSESGTD FTLTISSLQP
EDFATYYCQQ YWTFPVTFGQ GTKVEIKR

BMS2h-116-16 (SEQ ID NO: 978)
DIQMTQSPSS LSASVGDRVT ITCRASQPID PDLLWYQQKP
GKAPKLLIYQ TSILQSGVPS RFSGSGSGTV FTLTISSLQP
EDFATYYCQQ YWAFPVTFGQ GTKVEIKR

BMS2h-116-17 (SEQ ID NO: 979)
DIQMTQSPSS LSASVGDRVT ITCRASQPIG PDLLWYQQKP
GKAPKLLIYQ TSILRSGVPS RFSGSGSETD FTLTISNLQP
EDFATYYCQQ YWAFPVTFGQ GTKVEIKR

BMS2h-116-2 (SEQ ID NO: 980)
DIQMTQSPSS LSASVGDRVT ITCRASQPIE PDLLWYQQKP
GKAPKLLIYQ TSILQSGVPS RFSGSGSGTD FTLTISSLQP
EDFATYYCQQ YWASPVTFGQ GTKVEIKR

BMS2h-116-3 (SEQ ID NO: 981)
DIQMTQSPSS LSASVGDRVT ITCRASQPIG PDLLWYQQKP
GKAPKLLIYQ TSILQSGVPS RFSGSESGTD FTLTISSLQP
EDIATYYCQQ YWAFPVTFGQ GTRVEIKR

BMS2h-116-4 (SEQ ID NO: 982)
DIQMTQSPSS LSASVGDRVT ITCRASQPIG PDLLWYQQKP
GKAPKLLIYQ TSILQSGVPS RFSGSESGTD FTLTISSLQP
EDFATYYCQQ YWAFPVTFGQ GTKVEIKR

BMS2h-116-5 (SEQ ID NO: 983)
DIQMTQSPSS LSASVGDRVA ITCRASQPIG PDILWYQQKP
GKAPKLLIYQ TSILRSGVPS RFSGSGSGTD FTLTISSLQP
EDSATYYCQQ YWAFPVTFGQ GTKVEIKR

BMS2h-116-6 (SEQ ID NO: 984)
DIQMTQSPSS LSASVGDRVT ITCRASQPIG PDLLWYQQKP
GKAPKLLIYQ TSILRSGVPS RFSGSGSVTD FTLTISSLQP
EDFATYYCQQ YWAFPVTFGQ GTKVGIKR

BMS2h-116-7 (SEQ ID NO: 985)
DIQMTQSPSS LSASVGDRVT ITCRASQPID PDLLWYQQKP
GKAPKLLIYQ TSILQSGVPS RFSGSGSRTD FTLTISSLQP
EDFATYYCQQ YWAFPVTFGQ GTKVEIKR

BMS2h-116-8 (SEQ ID NO: 986)
DIQMTQSPSS LSASVGDRVT ITCRASQPIG PDLLWYQQKP
GKAPKLLIYQ TSILQSGVPS RFSGSGSTD FTLTISGLQP
EDFATYYCQQ YWAFPVTFGQ GTKVEIKR

BMS2h-116-9 (SEQ ID NO: 987)
DIQMTQSPSS LSASVGDRVT ITCRASMPIG PDLLWYQQKP
GKAPKLLIYQ TSILRSGVPS RFSGSESGTD FTLTISSLQP
EDFATYYCQQ YWAFPVTFGQ GTKVEIKR

BMS2h-141 (SEQ ID NO: 988)
DIQMTQSPSS LSASVGDRVT ITCRASQWIG DTLTWYQQKL
GKAPKLLIYG GSELQSGVPP RFSGSGSGTD FTLTISSLQP
EDFATYYCQQ CISSPCTFGQ GTKVEIKR

BMS2h-142 (SEQ ID NO: 989)
DIQMTQSPSS LSASVGDRVT ITCRASQFIG DSLSWYQQKP
GKAPKLLIYF SSILQSGVPS RFSGSGSGTD FTLTISSLQP
EDFATYYCQQ YHTSPTTFGR GTKVKIKR

BMS2h-143 (SEQ ID NO: 990)
DIQMTQSPSS LSASVGDRVT ITCRASQTIE TNLEWYQQKP
GKAPKLLIYD SSQLQSGVPS RFSGSGSGTD FTLTISSLQP
EDLATYYCQQ YHGYPTTFGQ GTKVEIKR

BMS2h-144 (SEQ ID NO: 991)
DIQMTQSPSS LSASVGDRVT ITCRASQMID QDLEWYQQKP
GKAPKLLIYN ASWLQSGVPS RFSGSGSGTD FTLTISSLQP
EDFATYYCQQ YHGYPITFGQ GTKVEIKR

BMS2h-145 (SEQ ID NO: 992)
DIQMTQSPSS LSASVGDRVT ITCRASQTIY TSLSWYQQKP
GKAPKLLIHY GSVLQSGVPS RFSGSGSGTD FTLTISSLQP
EDSATYYCQQ VHQAPTTFGQ GTKVEIKR

BMS2h-146 (SEQ ID NO: 993)
DIRMTQSPSS LSASVGDRVT ITCRASQWIG DSLAWYQQKP
GKAPKLLIYG ISELQSGVPS RFSGSGSGTD FTLTISSLQP
EDSATYYCQL SSSMPHTFGQ GTKVEIKR

BMS2h-147 (SEQ ID NO: 994)
DIQMTQSPSS LSASVGDRVT ITCRASQEIE TNLEWYQQKP
GKAPKLLIYD SSHLQSGVPS RFSGSGSGTD FTLTISSLQP
EDFATYYCQQ YHQNPPTFGQ GTKVEIKR

BMS2h-149 (SEQ ID NO: 995)
DIQMTQSPSS LSASVGDRVT ITCRASQWIG RQLVWYQQKP
GKAPKLLIYG ATELQSGVPS RFSGSGSGTD FTLTISSLQP
EDFATYYCQQ QSKGPLTFGH GTKVEIKR

BMS2h-150 (SEQ ID NO: 996)
DIQMTQSPSS LSASVGDRVT ITCRASQGIG TDLNWYQQKP
GKAPKLLIYM GSYLQSGVPS RFSGSGSGTD FTLTISSLQP
EDFATYYCQQ IYSFPITFGQ GTKVEIKR

BMS2h-154 (SEQ ID NO: 997)
DIQMTQSPSS LSASVGDRVT ITCRASDIE EMLHWYQQKP
GKAPKLLIYF GSLLQSGVPS RFSGSRSGTD FTLTISSLQP
EDFATYYCQQ HHTRPYTFGQ GTKVEIKR

BMS2h-155 (SEQ ID NO: 998)
DIQMTQSPSS LSASVGDRVT ITCRASQDIG MDLEWYQQIP
GKVPKLLIYD ASYLQSGVPS RFSGSGSGTD FTLTISSLQP
EDFATYYCQQ YHKLPATFGQ GTKVEIKR

BMS2h-156 (SEQ ID NO: 999)
DIQMTQSPSS LSASVGDRVT ITCRASQDIM DNLEWYQQKP
GKAPKLLIYA ASWLQSGVPS RFSGSGSGTD FTLTISSLQP
EDFATYYCQQ YHKLPVTFGQ GTKVEIKR

BMS2h-157 (SEQ ID NO: 1000)
DIQMTQSPSS LSASVGDRVT ITCRASQNIG EDLEWYQQKP
GNAPKLLIYS ASHLQSGVPS RFSGSGSGTD FTLTISSLQP
EDFATYYCQQ YSSYPVTFGQ GTKVEIKR

TABLE 3-continued

Anti-human CD40L VK Domain Amino Acid Sequences

BMS2h-158 (SEQ ID NO: 1001)
DIQMTQSPSS LSASVGDRVT ITCRASQPID EDLEWYQQKP
GNAPKLLIYS ASYLQSGVPS RFSGSGSGTD FTLTISRLQP
EDFATYYCQQ YHLLPATFGQ GTKVEIKR

BMS2h-159 (SEQ ID NO: 1002)
DIQMIQSPSS LSASVGDRVT ITCRASQDIN EDLEWYQQKP
GKAPKLLIYN ASMLQSGVPS RFSGSGSGTD FTLTISSLQP
KDFATYYCQQ YHTNPTTFGQ GTKVEIKR

BMS2h-160 (SEQ ID NO: 1003)
DIQMTQSPSS LSASVGDRVT ITCRASQDIE ADLEWYQQKP
GKAPKLLIYH SSELQSGVPS RFSGSGSGTD FTLTISSLQP
EDFATYYCQQ YHMSPVTFGQ GTKVEIKR

BMS2h-161 (SEQ ID NO: 1004)
DIQMTQSPSS LSASVGDRVT ITCRASQDID SDLEWYQQKP
GKAPMLLIYS SSDLQSGVPS RFSGSGSGTD FTLTISSLQP
EDFATYYCQQ YHSLPVTFGQ GTKVEIKR

BMS2h-162 (SEQ ID NO: 1005)
DIQMTQSPSS LSASVGDRVT ITCRASQDIS DDLEWYQQKP
GKAPKLLIYN SSFLQSGVPS RFSGSGSGAD FTLTISSLQP
EDFATYYCQQ YHSLPVTFGQ GTKVEIKR

BMS2h-163 (SEQ ID NO: 1006)
DIQMTQSPSS LSASVGDRVT ITCRASQDIE GNLEWYQQKP
GKAPKLLIYD SSQLQSGVPS RFSGSGSGTD FTLTISSLQP
EDFATYYCQQ YHHLPTTFGQ GTKVEIKR

BMS2h-164 (SEQ ID NO: 1007)
DIQMTQSPSS LSASVGDRVT ITCRASQSID TDLEWYQQKP
GKAPKLLIYD GSWLQSGVPS RFSGSGSGTD FTLTISSLQP
EDFATYYCQQ YRWIPVTFGQ GTKVEIKR

BMS2h-165 (SEQ ID NO: 1008)
DIQMTQSPSS LSASVGDRVT ITCRASQSIS TDLEWYQQKL
GKAPKLLIYD ASLLQSGVPS RFSGSGSGTD FTLTISSLQP
EDFATYYCQQ YSSLPVTFGQ GTKVEIKR

BMS2h-166 (SEQ ID NO: 1009)
DIQMTQSPSS LSASVGDRVT ITCRASQPIT TSLEWYQQKP
GKAPKLLIYD ASMLQSGVPS RFSGSGSGTD FTLTISSLQP
EDFATYYCQQ YWVTPVTFGQ GTKVEIKR

BMS2h-167 (SEQ ID NO: 1010)
DIQMTQSPSS LSASVGDRVT ITCRASQNIH TNLEWYQQKP
GKAPKLLIYD GSMLQSGVPS RFSGSGSGTD FTLTISSLQP
EDFATYYCQQ YSANPVTFGQ GTKVGIKR

BMS2h-168 (SEQ ID NO: 1011)
DIQMTQSPSS LSASVGDRVT ITCRASQWIH TDLEWYQQKP
GKAPKLLIYD GSMLQSGVPS RFSGSGSGTD FTLTISSLQP
EDFATYYCQQ YSVSPVTFGQ GTKVEIKR

BMS2h-169 (SEQ ID NO: 1012)
DIQMTQSPSS LSASVGDRVT ITCRASQSID NNLEWYQQKP
GEAPKLLIYD GSLLQSGVPS RFSGSGSGTD FTLTISSLQP
EDFATYYCQQ YHLHPVTFGQ GTKVEIKR

BMS2h-170 (SEQ ID NO: 1013)
DIQMTQSPSS LSASVGDRVT ITCRASQDID TNLEWYQQKP
GEAPKLLIYD RSTLQSGVPS RFSGSGSGTD FTLTISSLQP
EDFATYYCQQ YDSYPVTFGQ GTKVEIKR

BMS2h-171 (SEQ ID NO: 1014)
DIQMTQSPSS LSASVGDRVT ITCRASQSIE SNLEWYQQKP
GKAPKLLIYN ASELQSGVPS RFSGSGSGTD FTLTISSLRP
EDFATYYCQQ YDQWPTTFGQ GTKVEIKR

BMS2h-172 (SEQ ID NO: 1015)
DIQMTQSPSS LSASVGDRVT ITCRASQAIG NTLRWYQQKP
GKAPKLLIYL SSRLQSGVPS RFSGSGSGTD FTLTISSLQP
EDFATYYCQQ LKKPPYTFGQ GTKVEIKR

BMS2h-173 (SEQ ID NO: 1016)
DIQMTQSPSS LSASVGDRVT ITCRASQKIK NRLAWYQQKP
GKAPKLLIYE VSHLQSGVPS RFSGSGSGTD FTLTIGSLQP
EDFATYYCQQ RRQSPYTFGQ GTKVEIKR

BMS2h-174 (SEQ ID NO: 1017)
DIQMTQSPSS LSASVGDRVT ITCRASEDIG EELFWYQQKP
GKAPKLLIYS ASTLQSEVPS RFSGSGSGTD FTLTISSLQH
EDFATYYCQQ VYEWPYTFGQ GTKVEIKR

BMS2h-175 (SEQ ID NO: 1018)
DIQMTQSPSS LSASVGDRVT ITCRASQPIS GGLRWYQQKP
GKAPKLLIYS TSMLQSGVPS RFSGSGSGTD FTLTISSLQP
EDFATYYCQQ LYSAPYTFGQ GTKVEIKR

BMS2h-305 (SEQ ID NO: 1019)
DIQMTQSPSS LSASVGDRVT ITCRASQDID QDLEWYQQKP
GKAPKLLIYN VSLLQSGVPS RFSGSGSGTD FTLTISSLQP
EDFATYYCQQ YSMNPVTFGQ GTKVEIKR

BMS2h-306 (SEQ ID NO: 1020)
DIQMTQSPSS LSASVGDRVT ITCRASQDIG NQLKWYQQKP
GKAPKLLIYQ ASGLQSGVPS RFSGSGSGTD FTLTISSLQP
EDFATYYCQQ YDLRPQTFGQ GTKVEIKR

BMS2h-307 (SEQ ID NO: 1021)
DIQMTQSPSF LSASVGDRVT ITCRASQKIS TSLEWYQQKP
GKAPRLLIYD SSWLQSGVPS RFSGSGSGTD FTLTISSLQP
EDFATYYCQQ YEYNPITFGQ GTKVEIKR

BMS2h-33 (SEQ ID NO: 1022)
DIQMTQSPSS LSASVGDRVT ITCRASQTIG ESLHWYQQKP
GKAPRLLIYF ASLLQSGVPS RFSGSGSGTD FTLTISSLQP
EDFATYYCQQ HHMLPSTFGQ GTKVEIKR

BMS2h-35 (SEQ ID NO: 1023)
DIQMTQSPSS LSASVGDRVT ITCRASQFIG DSLSWYQQKP
GKAPKLLIYF SSILQSGVPS RFSGSGSGTD FTLTISSLQP
EDFATYYCQQ YMDIPITFGQ GTKVEIKR

BMS2h-36 (SEQ ID NO: 1024)
DIQMTQSPSS LSASVGDRVT ITCRASQDID HNLEWYQQKP
GKAPKLLIYD SSMLQSGVPS RFSGSGSGTD FTLTISSLQP
EDFATYYCQQ YHSIPVTFGQ GTKVEIKR

BMS2h-37 (SEQ ID NO: 1025)
DIQMTQSPSS LSASVGDRVT ITCRASQQIE TNLEWYQQKP
GKAPKLLIYD GSWLQSGVPS RFSGSGSGTD FTLTISSLQP
EDFATYYCQQ YHSLPATFGQ GTKVEIKR

BMS2h-38 (SEQ ID NO: 1026)
DIQMTQSPSS LSASVGDRVT ITCRASQDIG NNLEWYQQKP
GKAPRLLIYH GSWLQSGVPS RFSGSGSGTD FTLTISSLQP
EDFATYYCQQ YDFNPTTFGQ GTKVEIKR

BMS2h-39 (SEQ ID NO: 1027)
DIQMTQSPSS LSASVGDCVT ITCRASQNID GLLWWYQQKP
GKAPKLLIYA GSGLQSGVPS RFSGSGSGTD FTLTISSLQP
EDFATYYCQQ KAFEPFTFGQ GTKVEIKR

BMS2h-405 (SEQ ID NO: 1028)
DIQMTQTPSS LSASVGDRVT ITCRASQSIG HDLEWYQQKP
GKAPKLLIYN VSWLQSGVPS RFSGSGSGTD FTLTISSLQP
EDFATYYCQQ YSHNPPTFGQ GTKVEIKR

BMS2h-406 (SEQ ID NO: 1029)
DIQMTQSPSS LSASVGDRVT ITCRASQHIE NDLEWYQQKP
GKAPKLLIYS ASHLQSGVPS RFSGSGSGTD FTLTISSLQP
EDFATYYCQQ YHLQPTTFGP GTKVEIKR

BMS2h-431 (SEQ ID NO: 1030)
DIQMTQSPSS LSASVGDRVT ITCRASQVIE GSLNWYQQKP
GKAPKLLIYH RSILQSGVPS RFSGRGSGTD FTLTISSLQP
EDFATYYCQQ TYQLPLTFGQ GTKVEIKR

BMS2h-432 (SEQ ID NO: 1031)
DIQMTQSPSS LSASVGDRVT ITCRASRPIN GKLFWYQQKP
GKAPKLLIAF ASALQSGVPS RFSGSGSGTD FTLTISSLQP
EDFATYYCVQ QAVYPITFGQ GTKVEIKR

TABLE 3-continued

Anti-human CD40L VK Domain Amino Acid Sequences

```
BMS2h-433 (SEQ ID NO: 1032)
DIQMTQSPSS LSASVGDRVT ITCRASQAIE TNLEWYQQKP
GKAPKLLIYD GSLLQSGVPS RFSGRGSGTD FTLTISSLQP
EDFATYYCQQ YHYQPATFGQ GTKVEIKR

BMS2h-434 (SEQ ID NO: 1033)
DIQMTQSPSS LSASVGDRVT ITCRASQDIE HDLEWYQQKP
GKAPKLLIYS ASQLQSGVPS RFSGSGSGTD FTLTISSLQP
EDFATYYCQQ YQQQPTTFGQ GTKVEIKR

BMS2h-435 (SEQ ID NO: 1034)
DIQMTQSPSS LSASVGDRVT ITCRASSQIE ESLWWYQQKP
GKAPKLLIAD VSLLQSGVPS RFSGSGSGTD FTLTISSLQP
EDFATYYCAQ GVVEPRTFGQ GTKVEIKR

BMS2h-436 (SEQ ID NO: 1035)
DIQMTQSPSS LSASVGDRVT ITCRASQYIG LDLEWYQQKP
GKAPKLLIYA ASWLQSGVPS RFSGSGSGTD FTLTISSLQP
EDFATYYCQQ YFRQPITFGQ GTKVEIKR

BMS2h-437 (SEQ ID NO: 1036)
DIQMTQSPSS LSASVGDRVT ITCRASTPIG TMLDWYQQKP
GKAPKLLIGH SSWLQSGVPS RFSGSGSGTD FTLTISSLQP
EDFATYYCGQ HVRPPATFGQ GTKVEIKR

BMS2h-437-1 (SEQ ID NO: 1037)
DIQLTQSPTS LSATVGDRVT ITCRASTPIG TMLDWYQQKP
GKAPKLLIGH SSWLQSGVPS RFSGSGSGTD FTLTISSLQP
EDFATYYCGQ HVRHPATFGQ GTKVEIKR

BMS2h-437-2 (SEQ ID NO: 1038)
DIQMTQSPSS LSASVGDRVT ITCRASTPIG TMLDWYQQKP
GKAPKLLIGH SSWLQSGVPS RFSGSGSGTD FTLTISSLQP
EDFATYYCGQ HVRPPATFGQ GTKVGIKR

BMS2h-437-3 (SEQ ID NO: 1039)
DIQMTQSPSS LSASVGDRVT ITCRVSTPIG TMLDWYQQKP
GKAPKLLIGH SSWLQSGVPP RFSGSGSGTD FTLTISSLQP
EDFATYYCGQ HVRPPATFGQ GTKVEIKR

BMS2h-437-4 (SEQ ID NO: 1040)
DIQMTQSPSS LSASVGDRVT ITCRASTPIG TMLDWYQQKP
GKAPKLLIGH SSWLQSGVPS RFSGCGSGTD FTLTISSLQP
EDFATYYCGQ HVRPPATFGQ GTKVEIKR

BMS2h-437-5 (SEQ ID NO: 1041)
DIQMTQSPSS LSASVGDRVT ITCRASTPIG TMIDWYQQKP
GKAPKLLIGH SSWLQSGVPS RFSGSGSGTD FTLTISSLQP
EDFATYYCGQ HVRPPATFGK GTKVEIKR

BMS2h-438 (SEQ ID NO: 1042)
DIQMTQSPSS LSASVGDRVT ITCRASQYID TNLEWYQQKP
GKAPRLLIYD GSQLQSGVPS RFSGSGSGTD FTLIISSLQP
EDFATYYCQQ YQVVPVTFGQ GTKVEIKR

BMS2h-439 (SEQ ID NO: 1043)
DIQMTQSPSS LSASVGDRVT ITCRASQSIS SYLNWYQQKP
GKAPRLLIVD SSGLQSGVPS RFSGSGSGTD FTLTISSLQP
EDFATYYCGQ DRWSPATFGQ GTKVEIKR

BMS2h-440 (SEQ ID NO: 1044)
DIQMTQSPSS LSASVGDRVT ITCRASSRIQ HMLSWYQQKP
GKAPKLLIGG HSGLQSGVPS RFSGSGSGTD FTLTISSLQP
EDFATYYCAQ SCAWPLTFGQ GTKVEIKR

BMS2h-441 (SEQ ID NO: 1045)
DIQMTQSPSS LSASVGDRVT ITCRASRGID GDLWYQQKP
GKAPKLLIAD SSLLQSGVPS RFSGSGSGTD FTLTISSLQP
EDFATYYCGQ GAVRPMTFGQ GTKVEIKR

BMS2h-442 (SEQ ID NO: 1046)
DIQMTQSPSS LSASVGDRVT ITCRASRGID TDLWWYQQKP
GKAPKLLIAD SSLLQSGVPS RFSGSGSGTD FTLTISSLQP
EDFATYYCGQ GAVRPMTFGQ GTKVEIKR

BMS2h-443 (SEQ ID NO: 1047)
DIQMTQSPSS LSASVGDRVT ITCRASYTIP VALDWYQQKP
GKAPKLLIAD ASLLQSGVPS RFSGSGSGTD FTLTISSLQP
EDFATYYCAQ GWPGPQTFGQ GTKVEIKR

BMS2h-444 (SEQ ID NO: 1048)
DIQMTQSPSS LSASVGDRVT ITCRASQSIA TDLEWYQQKP
GKAPKLLIYD TSMLQSGVPS RFSGSGSGTD FTLTISSLQP
EDFATYYCQQ YSYNPSTFGQ GTKVEIKR

BMS2h-445 (SEQ ID NO: 1049)
DIQMTQSPSS LSASVGDRVT ITCRASVPIT EGLSWYQQKP
GKAPKLLIQA NSWLQSGVPS RFSGSGSGTD FTLTISSLQP
EDFATYYCGQ WEHVPATFGQ GTKVEIKR

BMS2h-446 (SEQ ID NO: 1050)
DIQMTQSPSS LSASVGDRVT ITCRASSMIL YGLDWYQQKP
GKAPKLLIGG TSALQSGVPS RFSGSGSGTD FTLTISSLQP
EDFATYYCGQ WETVPATFGQ GTKVEIKR

BMS2h-447 (SEQ ID NO: 1051)
DIQMTQSPSS LSASVGDRVT ITCRASQPIN GLLIWYQQKP
GKAPKLLIYA MSSLQSGVPS RFSGSGSGTD FTLTISSLQP
EDFATYYCQQ LARIPFTFGQ GTKVGIKR

BMS2h-448 (SEQ ID NO: 1052)
DIQMTQSPSS LSASVGDRVT ITCRASQLIR TYLAWYQQKP
GKAPKLLIYQ SSQLQSGVPS RFSGSGSGTD FTLTISSLQP
EDFATYYCQQ YNSYPDTFGQ GTKVEIKR

BMS2h-47 (SEQ ID NO: 1053)
DIQMTQSPSS LSASVGDRVT ITCRASQWIG DSLSWYQQKP
GKAPKLLIYF GSYLQSGVPS RFSGSGSGTD FTLTISSLQP
EDFATYYCQQ YLHTPSTFGQ GTKVEIKR

BMS2h-484 (SEQ ID NO: 1054)
DIQMTQSPSS LSASVGDRVT ITCRASQDIE ADLEWYQQKP
GKAPKLLIYH SSELQSGVPS RFSGSGSGTD FTLTISSLQP
EDFATYYCQQ YGFNPPTFGQ GTKVEIKR

BMS2h-485 (SEQ ID NO: 1055)
DIQMTQSPSS LSASVGDRVT ITCRASSPIE YGLDWYQQKP
GKAPKLLIGG GSALQSGVPS RFSGSGSGTD FTLTISSLQP
EDFATYYCGQ WEVQPATFGQ GTKVEIKR

BMS2h-486 (SEQ ID NO: 1056)
DIQMTQSPSS LSASVGDRVT ITCRASQRID TDLEWYQQKP
GKAPKLLIYD SSQLQSGVPS RFSGSGSGTD FTLTISSLQP
EDFATYYCQQ YHSAPATFGQ GTKVEIKR

BMS2h-487 (SEQ ID NO: 1057)
DIQMTQSPSS LSASVGDRVT ITCRASGWIG MSLEWHQQKP
GKAPKLLIRG ASSLQSGVPS RFSGSGSGTD FTLTISSLQP
EDFATYYCSQ SRWPPVTFGQ GTKVEIKR

BMS2h-488 (SEQ ID NO: 1058)
DIQMTQSPSS LSASVGDRVT ITCRASRNIS NALSWYQQKP
GKAPKLLILG ASWLQSGVPS RFSGSGSGTD FTLTISSLQP
EDFATYYCTQ VWDRPFTFGQ GTKVEIKR

BMS2h-489 (SEQ ID NO: 1059)
DIQMTQSPSS LSASVGDRVT ITCRASQDIM SALSWYQQKP
GKAPKLLIYS TSILQSGVPS RFSGSGSGTD FTLTISSLQP
EDFATYYCQQ VYLLPVTFGQ GTKVEIKR

BMS2h-490 (SEQ ID NO: 1060)
DIQMTQSPSS LSASVGDRVT ITCRASQEIG IDLEWYQQKP
GKAPKLLIYA ASYLQSGVPS RFSSSGSGTD FTLTISSLQP
EDFATYYCQQ YASNPPTFGR GTKVEIKR

BMS2h-491 (SEQ ID NO: 1061)
DIQMTQSPSS LSASVGDRVT ITCRASQMIG DWLNWYQQKP
GKAPKLLIYR SSELQSGVPS RFSGSGSGTD FTLTISSLQP
EDFATYYCQQ LYFWPRTFGQ GTKVEIKR
```

TABLE 3-continued

Anti-human CD40L VK Domain Amino Acid Sequences

BMS2h-492 (SEQ ID NO: 1062)
DIQMTQSPSS LSASVGDRVT ITCRASQAIE LNLEWYQQKP
GKAPKLLIYD ASMLQSGVPS RFSGSGSGTD FTLTISSLQP
EDFATYYCQQ YDVYPPTFGQ GTKVEIKR

BMS2h-492-1 (SEQ ID NO: 1063)
DIQMTQSPSS LSASVGDRVT ITCRASQAIE HNLEWYQQKP
GKAPKLLIYD ASMLQSGVPS RFSGSGSGTD FTLTISSLQP
EDLATYYCQQ YDAYPPTYGQ GTKVEIKR

BMS2h-492-2 (SEQ ID NO: 1064)
DIQMTQSPSS LSASVGDRVT ITCRASRAIE TNLEWYQQKP
GKAPKLLFYD ASMLQSGVPS RFGGSGSGTD FTLTISSLQP
EDFATYYCLQ YDVYPPTFGQ GTKVEIKR

BMS2h-492-3 (SEQ ID NO: 1065)
DIQMTQSPSS LSATVGDRVT ITCRASQAIE TNLEWYQQKP
GKAPKLLIYD ASMLQSGVPS RFSGSGSGTD FTLTISSLQP
EDFATYYCQQ YDAYPPTFGQ GTKVEIKR

BMS2h-492-4 (SEQ ID NO: 1066)
DIQMTQSPSS LSASVGDRVT ITCRASQAIE HNLEWYQQKP
GKAPKLLIYD ASMLQSGVPS RFSGRGSGTD FTLTISSLQP
EDFATYYCQQ YDAYPPTFGQ GTKVEIKR

BMS2h-492-5 (SEQ ID NO: 1067)
DIQMNQSPSS LSASVGDRVS ITCRASQAIE HNLEWYQQKP
GKAPKLLIYD ASMLQSGVPS RFSGSGSGTD FTLTISSLQP
EDFATYYCQQ YDAYPPTFGQ GTKVEIKR

BMS2h-492-6 (SEQ ID NO: 1068)
DIQMTQSPSS LSASVGDRVT ITCRASQAIE SNLEWYQQKP
GKAPKLLIYD ASMLQSGVPS RFSGSGSGTD FTLTISSLQP
EDFATYYCQQ YDVYPPTFGQ GTKVEIKR

BMS2h-492-7 (SEQ ID NO: 1069)
DIQMTQSPSS LSASVGDRVT ITCRASQAIE HNLEWYQQKP
GKAPKLLIYD ASMLQSGVPS RFSGSGSGTD FTLTISSLQP
EDFATYYCQQ YDAYPPTFGQ GTKVEIKR

BMS2h-493 (SEQ ID NO: 1070)
DIQMTQSPSS LSASVGDRVT ITCRASQGID EDLEWYQQKP
GKAPRLLIYS SSWLQSGVPS RFSGSGSGTD FTLTISSLQP
EDFATYYCQQ YFQYPPTFGQ GTKVEIKR

BMS2h-494 (SEQ ID NO: 1071)
DIQMTQSPSS LSASVGDRVT ITCRASQSID EDLEWYQQKP
GKAPRLLIYS SSWLQSGVPS RFSGSGSGTD FTLTISSLQP
EDFATYYCQQ YFQYPPTFGQ GTKVEIKR

BMS2h-494-1 (SEQ ID NO: 1072)
DIQMTQSPSS LSASVGDRVT ITCRASQSID EDLEWYQQKP
GKAPRLLIYS SSWLQSGVPS RFSGSGSGTD FTLTISSLQP
EDFATYYCQQ YSQYPPTFGQ GTKVEIKR

BMS2h-494-2 (SEQ ID NO: 1073)
DIQMTQSPSS LSASVGDRVT ITCRASQSIE EDLEWYQQKP
GKAPRLLIYS SSWLQSGVPS RFSGSGSGTD FTLTISSLQP
EDFATYYCQQ YFQYPPTFGH GTKVEIKR

BMS2h-494-3 (SEQ ID NO: 1074)
DIQMTQSPSS LSASVGDRVT ITCRASQSID EDLEWYQQKP
GKAPRLLIYS SSWLQSGVPS RFSGSGSGTD FTLTISSLQP
EDFATYFCQQ YFQYPPTFGQ GTKVEIKR

BMS2h-494-4 (SEQ ID NO: 1075)
EIQMTQSPSS LSASVGDRVT MTCRASQSID KDLEWYQQKP
GKAPRLLIYS SSWLQRGVPS RFSGSGSGTD FTLTISSLRP
EDFATYYCQQ YFQYPPTLGQ GTKVEIKR

BMS2h-494-5 (SEQ ID NO: 1076)
DIQMTQSPSS LSASVGDRVT ITCRASQSID EDLEWYQQKP
GKAPRLLIYS SSWLQSGVPS RFSGSGSGTD FTLTISGLQP
EDIATYYCKQ YSQYPPTFGQ GTKVEIKR

BMS2h-494-6 (SEQ ID NO: 1077)
DIQMTQSPPS LSASVGDRVT ITCRASQSID KDLEWYQQKP
GKAPRLLIYS SSWLQRGVPS RFSGSGSGTD FTLTISSLQP
EDFATYHCQQ YFQYPPTFGQ GTKVEIKR

BMS2h-495 (SEQ ID NO: 1078)
DIQMTQSPSS LSASVGDRVT ITCRASEYIN AELAWYQQKP
GKAPKLLIYG SSGLQSGVPS RFSGSGSGTD FTLTISSLQP
EDFATYYCLQ NAMWPITFGQ GTKVEIKR

BMS2h-496 (SEQ ID NO: 1079)
DIQMTQSPSS LSASVGDRVT ITCRASLDIN NGLIWYQQKP
GKAPRLLILG ASGLQSGVPS RFSGSGSGTD FTLTISSLQP
EDFATYYCSQ VRSRPFTFGQ GTKVEIKR

BMS2h-497 (SEQ ID NO: 1080)
DIQMTQSPSS LSASVGDRVT ITCRASQDIL SALAWYQQKP
GKAPKLLIYG SSVLQSGVPS RFSGSGSGTD FTLTISSLQP
EDFATYYCQQ NYSLPITFGQ GTKVEIKR

BMS2h-498 (SEQ ID NO: 1081)
DIQMTQSPSS LSASVGDRVT ITCRASSPIE SYLRWYQQKP
GKAPKLLIRY VSVLQSGVPS RFSGSGSGTD FTLTISSLQP
EDFATYYCGQ WFRAPVTFGQ GTKVEIKR

BMS2h-499 (SEQ ID NO: 1082)
DIQMTQSPSS LSASVGDRVT ITCRVSESIN AELHWYQQKP
GKAPKLLISG FSGLQSGVPS RFSGSGSGTD FTLTISSLQP
EDFATYYCVQ FAMWPFTFGQ GTKVEIKR

BMS2h-500 (SEQ ID NO: 1083)
DIQMTQSPSS LSASVGDRVT ITCRASMMIR FGLDWYQQKP
GKAPKLLIGG GSSLQSGVPS RFSGSGSGTD FTLTISSLQP
EDFATYYCGQ HERWPATFGQ GTKVEIKR

BMS2h-501 (SEQ ID NO: 1084)
DIQMTQSPSS LSASVGDRVT ITCRASQSIG TLLRWYQQKP
GKAPKLLIYL TSVLQSGVPS RFSGSGSGTD FTLTISSLQP
EDFATYYCQQ MVYRPYTFGQ GTKVEIKR

BMS2h-502 (SEQ ID NO: 1085)
DIQMTQSPSS LSASVGDRVT ITCRASQTIE TNLEWYQQKP
GKAPKLLIYD SSQLQSGVPS RFSGSGSGTD FTLTISSLQP
EDFATYYCQQ YDKVPATFGQ GTKVEIKR

BMS2h-503 (SEQ ID NO: 1086)
DIQMTQSPSS LSASVGDRVT ITCRASHHIQ RYLSWYQQKP
GKAPKLLILW GSQLQSGVPS RFSGSGSGTD FTLTISSLQP
EDFATYYCGQ WWAPPPTFGQ GTKVEIKR

BMS2h-503-1 (SEQ ID NO: 1087)
DIQMTQSPSS LSASVGDRVT ITCRASHHIQ RYLSWYQQKP
GKAPKLLILW GSQLQSGVPS RFSGSGSGTD FTLTISSLQP
EDFATYYCGQ WWAPPQTFGQ GTKVEIKR

BMS2h-503-2 (SEQ ID NO: 1088)
DIQMTQSPSS LSASVGDRVT ITCRASHDIQ RYLSWYQQKP
GKAPKLLILW GSQLQSGVPS RFSGSGSGTD FTLTISSLQP
EDFATYYCGQ WWAPPQTFGQ GTKVEIKR

BMS2h-504 (SEQ ID NO: 1089)
DIQMTQSPSS LSASVGDRVT ITCRASQYID TNLEWYQQKP
GKAPKLLIYD GSLLQSGVPS RFSGSGSGTD FTLTISSLQP
EDFATYYCGQ GAVVPVTFGQ GTKVEIKR

BMS2h-508 (SEQ ID NO: 1090)
DIQMTQSPSS LSASVGDRVT ITCRASQDIA FDLEWYQQKP
GKAPKLLIYS ASMLQSGVPS RFSGSGSGSD FTLTISSLQP
EDFATYYCQQ YNLQPPTFGQ GTKVEIKR

BMS2h-509 (SEQ ID NO: 1091)
DIQMTQSPSS LSASVGDRVT ITCRASQNIA TLLRWYQQKP
GKAPKLLIYA GSMLQSGVPS RFSGSGSGTD FTLTISSLQP
EDFATYYCQQ MWQRPYTFGQ GTKVEIKR

BMS2h-51 (SEQ ID NO: 1092)
DIQMTQSPSS LSASVGDRVT ITCRASQPIV DELDWYQQKP
GKAPKLLIYA ASILQSGVPS RFSGSGSGTD FTLTISSLQP
EDFATYYCHQ WSTYPTTFGQ GTKVEIKR

TABLE 3-continued

Anti-human CD40L VK Domain Amino Acid Sequences

BMS2h-510 (SEQ ID NO: 1093)
DIQMTQSPSS LSASVGDRVT ITCRASQSIS SYLNWYQQKP
GKAPKLLIDG VSGLQSGVPS RFSGSGSGTD FTLTISSLQP
EDFATYYCGQ DWDWPRTFGQ GTKVEIKR

BMS2h-511 (SEQ ID NO: 1094)
DIQMTQSPSS LSASVGDRVT ITCRASRNIR DWLRWYQQKP
GKAPKLLIDW GSVLQSGVPS RFSGSGSGTD FTLTISSLQP
EDFATYYCAQ TWDDPLTFGQ GTKVEIKR

BMS2h-511-1 (SEQ ID NO: 1095)
DIQMTQSPSS LSAFVGDRVT ITCRASRNIR DWLRWYQQKP
GKAPKLLIDW GSELQSGVPS RFSGSGSGTD FTLTISSLQP
EDFATYYCAQ TWYDPLTFGH GTKVEIKR

BMS2h-512 (SEQ ID NO: 1096)
DIQMTQSPSS LSASVGDRVT ITCRASIDIH GGLTWYQQKP
GKAPKLLIVG VSGLQSGVPS RFSGSGSGTD FTLTISNLQP
EDFATYYCAQ VWRRPFTFGQ GTKVEIKR

BMS2h-513 (SEQ ID NO: 1097)
DIQMTQSPSS LSASVGDRVT ITCRASQDIG SSLSWYQQKP
GKAPKLLIYA SSLLQSGVPS RFSGSGSGTD FTLTISSLQP
EDFATYYCQQ TYALPVTFGQ GTKVEIKR

BMS2h-514 (SEQ ID NO: 1098)
DIQMTQSPSS LSASVGDRVT ITCRASQQIE TNLEWYQQKP
GKAPKLLIYD GSWLQSGVPS RFSGSGSGTD FTLTISSLQP
EDFATYYCQQ YKYLPVTFGQ GTKVEIKR

BMS2h-52 (SEQ ID NO: 1099)
DIQMTQSPSS LSASVGDRVT ITCRASQDIG SALRWYQQKP
GKAPKLLIYL GSDLQSGVPS RFSGSGSGTD FTLTISSLQP
EDFATYYCQQ TQYFPTTFGQ GTKVEIKR

BMS2h-53 (SEQ ID NO: 1100)
DIQMTQSPSS LSASVGDRVT ITCRASQAIY GGLRWYQQKP
GKAPKLLIYG ESMLQSGVPS RFSGSGSGTD FTLTISSLHP
EDFATYYCQQ VYHKPFTFGQ GTKVEIKR

BMS2h-536 (SEQ ID NO: 1101)
DIQMTQSPSS LSASVGDRVT ITCRASQRIG VWLDWYQQKP
GKAPKLLIYD GSFLQSGVPS RFSGSGSGTD FTLTISSLQP
EDFATYYCQQ TFSSPSTFGQ GTKVEIKR

BMS2h-537 (SEQ ID NO: 1102)
DIQMTQSPSS LSASVGDRVP ITCRASQWIG DELYWYQQKP
GKAPKLLIYS SSTLQSGVPS RFSGSGSGTD FTLTISSLQP
EDFATYYCQQ SFQFPYTFGQ GTKVEIKR

BMS2h-538 (SEQ ID NO: 1103)
DIQMTQSPSS LSASVGDRVT ITCRASSNIT GPLEWYQQKP
GKAPKLLIPG WSTLQSGVPS RFSGSGSGTD FTLTISSLQP
EDFATYYCGQ VWGEPVTFGQ GTKVEIKR

BMS2h-539 (SEQ ID NO: 1104)
DIQMTQSPSS LSASIGDRVT ITCRASQRIA YGLHWYQQKP
GKAPRLLIGG RSGLQSGVPS RFSGSGSGTD FTLTISSLQP
EDFATYYCVQ PGMPPDTFGQ GTKVEIKR

BMS2h-540 (SEQ ID NO: 1105)
DIQMTQSPSS LSASVGDRVT ITCRASKQIV GGLSWYQQKP
GKAPKLLIGR HSGLQSGVPS RFSGSGSGTD FTLTISSLQP
EDFATYYCVQ GVWAPGTFGQ GTKVEIKR

BMS2h-541 (SEQ ID NO: 1106)
DIQMTQSPSS LSASVGDRVT ITCRASPAIA AKLDWYQQKP
GKAPKLLIGA DSGLQSGVPS RFSGSGSGTD FTLTISSLQP
EDFATYYCGQ LWAGPPTFGQ GTKVEIKR

BMS2h-542 (SEQ ID NO: 1107)
DIQMTQSPSS LSASVGDRVT ITCRASRTIA DGLDWYQQKP
GKAPKLLIGA YSGLQSGVPS RFSGSGSGTD FTLTISSLQP
EDFATYYCGQ LWEGPPTFGQ GTKVEIKR

BMS2h-543 (SEQ ID NO: 1108)
DIQMTQSPSS LSASVGDRVT ITCRASQRIY GFLDWYQQKP
GKAPKLLIYG VSSLQSGVPS RFSGSGSGTD FTLTISSLQP
EDFATYYCQQ TLAWPFTFGQ GTKVEIKR

BMS2h-544 (SEQ ID NO: 1109)
DIQMTQSPSS LSASVGDRVT ITCRASQDIR DWLMWYQQKP
GKAPKLLIYW GSFLQSGVPS RFSGSGSGTD FTLTISSLQP
EDFATYYCQQ LYDTPYTFGQ GTKVEIKR

BMS2h-545 (SEQ ID NO: 1110)
DIQMTQSPSS LSASVGDRVT ITCRASQNIN TGLDWYQQKP
GKAPKLLIYD SSALQSGVPS RFSGSGSGTD FTLTISSLQP
EDFATYYCQQ TSYYPYTFGQ GTKVEIKR

BMS2h-546 (SEQ ID NO: 1111)
DIQMTQSPSS LSASVGDRVT ITCRASQKIF GWLDWYQQKP
GKAPKLLIYG TSKLQSGVPS RFSGSGSGTD FTLTISSLQP
EDFATYYCQQ VYSLPYTFGQ GTKVEIKR

BMS2h-547 (SEQ ID NO: 1112)
DIQMTQSPSS LSASVGDRVT ITCRASSNIG ADLDWYQQKP
GKAPKLLIGG ASGLQSGVPS RFSGSGSGTD FTLTISSLQP
EDFATYYCGQ LWNGPPTFGQ GTKVEIKR

BMS2h-548 (SEQ ID NO: 1113)
DIQMTQSPSS LSASVGDRVT ITCRASSPIY DGLDWYQQKP
GKAPKLLISG ASWLQSGVPS RFSGSGSGTD FTLTISSLQP
EDFATYYCGQ LWLGPPTFGQ GTKVEIKQ

BMS2h-549 (SEQ ID NO: 1114)
DIQMTQSPSS LSASVGDRVT ITCRASSRIY NGLHWYQQKP
GKAPKLLIGG RSGLQSGVPS RFSGSGSGTD FTLTISSLQP
EDFATYYCAQ VGEAPSTFGQ GTKVEIKR

BMS2h-550 (SEQ ID NO: 1115)
DIQMTQSPSS LSASVGDRVT ITCRASRFIN EELDWYQQKP
GKAPKLLISW SSWLQSGVPS RFSGSGSGTD FTLTISSLQP
EDFATYYCVQ PGGGPGTFGQ GTKVEIKR

BMS2h-551 (SEQ ID NO: 1116)
DIQMTQSPSS LSASVGDRVT ITCRASRDIL DELDWYQQKP
GKAPRLLIGG GSGLQSGVPS RFSGSGSGTD FTLTISSLQP
EDFATYYCGQ LWHGPPTFGQ GTKVEIKR

BMS2h-552 (SEQ ID NO: 1117)
DIQMTQSPSS LSASVGDRVT ITCRASSPIY TGLHWYQQKP
GKAPKLLIGG RSGLQSGVPS RFSGSGSGTD FTLTISSLQP
EDFATYYCMQ VGTAPATFGQ GTKVEIKR

BMS2h-585 (SEQ ID NO: 1118)
DIRMTQSPSS LSASVGDRVT ITCRASQNIS RRLLWYQQKP
GKAPKLLIYS SSRLQSGVPS RFGGSGSGTD FTLTISSLQP
EDFATYYCQQ TYSYPHTFGQ GTKVEIKR

BMS2h-604 (SEQ ID NO: 1119)
DIQMTQSPSS LSASVGDRVT ITCRASSPIP QDLYWYQQKP
GKAPKLLIVG ISQLQSGVPS RFSGSGSGTD FTLTISSLQP
EDFATYYCGQ LWSAPATFGQ GTKVEIKR

BMS2h-605 (SEQ ID NO: 1120)
DIQMTQSPSS LSASVGDRVT ITCRASKSID GMLDWYQQKP
GKAPKLLIPG FSGLQSGVPS RFSGSGSGTD FTLTISSLQP
EDFATYYCGQ SVEAPWTFGQ GTKVEIKR

BMS2h-606 (SEQ ID NO: 1121)
DIQMTQSPSS LSASVGDRVT ITCRASRYIA HPLDWYQQKP
GKAPKLLIPG SSVLQSGVPS RFSGSGSGTD FTLTISSLQP
EDFATYYCGQ SVVVPWTFGQ GTKVEIKR

BMS2h-607 (SEQ ID NO: 1122)
DIQMTQSPSS LSASVGDRVT ITCRASRTIE GGLDWYQQKP
GKAPKLLIMG GSGLQSGVPS RFSGSGSGTD FTLTISSLQP
EDFATYYCGQ LWVGPPTFGQ GTKVEIKR

BMS2h-608 (SEQ ID NO: 1123)
DIQMTQSPSS LSASVGDRVT ITCRASKFIR DELYWYQQKP
GKAPRLLIGG SSLLQSGVPS RFSGSGSGTD FTLTISSLQP
EDFATYYCGQ LWRAPATFGQ GTKVEIKR

TABLE 3-continued

Anti-human CD40L VK Domain Amino Acid Sequences

BMS2h-609 (SEQ ID NO: 1124)
DIQMTQSPSS LSASVGDRVT ITCRASKPIY GGLEWYQQKP
GKAPRLLIGG GSVLQSGVPS RFSGSGSGTD FTLTISSLQP
EDFATYYCGQ VWGGPVTFGQ GTKVEIKR

BMS2h-610 (SEQ ID NO: 1125)
DIRMTQSPSS LSASVGDRVT ITCRASRPIS GCLDWYQQKP
GKAPKLLIDG ASGLQSGVPS RFSGSGSGTD FTLTISSLQP
EDFATYYCGQ WWEYPPTFGQ GTKVEIKR

BMS2h-611 (SEQ ID NO: 1126)
DIQMTQSPSS LSASVGDRVT ITCRASKPIV RDLEWYQQKP
GKAPKLLIHG VSTLQSGVPS RFSGSGSGTD FTLTISSLQP
EDFATYYCGQ LEAAPATFGQ GTKVEIKR

BMS2h-612 (SEQ ID NO: 1127)
DIQMTQSPSS LSASVGDRVT ITCRASRDIG DWLYWYQQKP
GKAPRLLIVW ASVLQSGVPS RFSGSGSGTD FTLTISSLQP
EDFATYYCAQ WGTPPTTFGQ GTKVEIKR

BMS2h-613 (SEQ ID NO: 1128)
DIQMTQSPSS LSASVGDRVT ITCRASNRIE YGLDWYQQKP
GKAPKLLISG SSRLQSGVPS RFSSSGSGTD FTLTISSLQP
EDFATYYCGQ LEAAPATFGQ GTKVEIKR

BMS2h-614 (SEQ ID NO: 1129)
DIQMTQSPSS LSASVGDRVT ITCRASRNIG HFLDWYQQKP
GKAPKLLILG GSSLQSGVPS RFSGSGSGTD FTLTISSLQP
EDFATYYCGQ LVEPPATFGQ GTKVEIKR

BMS2h-615 (SEQ ID NO: 1130)
DIQMTQSPSS LSASVGDRVT ITCRASSSIY SDLYWYQQKP
GKAPKLLIDG WSGLQSGVPS RFSGSGSGTD FTLTISSLQP
EDFATYYCGQ LHRAPATFGQ GTKVEIKR

BMS2h-616 (SEQ ID NO: 1131)
DIQMTQSPSS LSASVGDRVT ITCRASRFIT DRLDWYQQKP
GKAPKLLIGG VSGLQSGVPS RFSGSGSGTD FTLTISSLQP
EDFATYYCGQ SSELPWTFGQ GTKVEIKR

BMS2h-617 (SEQ ID NO: 1132)
DIQMTQSPSS LSASVGDRVT ITCRASRKIG SELYWYQQKP
GKAPKLLIGG RSRLQSGVPS RFSGSGSGTD FTLTISSLQP
EDFATYYCGQ LWEPPATFGQ GTKVEIKR

BMS2h-618 (SEQ ID NO: 1133)
DIQMTQSPSS LSASVGDRVT ITCRASRNIG NGLDWYQQKP
GKAPKLLIGE GSRLQSGVPS RFSGSGSGTD FTLTISSLQP
EDFATYYCGQ LWHTPPTFGQ GTKVEIKR

BMS2h-619 (SEQ ID NO: 1134)
DIQMTQSPSS LSASVGDRVT ITCRASRNIY GWLSWYQQKP
GKAPRLLIGG WSGLQSGVPS RFSGSGSGTD FTLTISSLQP
EDFATYYCAQ DYTLPGTFGQ GTKVEIKR

BMS2h-730 (SEQ ID NO: 1135)
DIQMTQSPSS LSASVGDRVT ITCRASQIK DWLHWYQQKP
GKAPKLLIYF ASGLQSGVPS RFSGSGSGTD FTLTISSLQP
EDSATYYCQQ HYSTPYTSGQ GTKVEIKR

BMS2h-731 (SEQ ID NO: 1136)
DIQMTQSPPS LSASVGDRVT ITCRASQLIS SHLDWYQQKP
GKAPKLLVYD ASELQSGVPS RFSGSGSGTD FTLTISSLQP
EDFATYYCQQ HRSLPFTFGQ GTKVEIKR

BMS2h-732 (SEQ ID NO: 1137)
DIQMTQSPSS LSASVGDRVT ITCRASQWIG GALAWYQQKP
GKAPRLLIYQ ISVLQSGIPS RFSGSGSGTD FTLTISSLQP
EDFATYYCQQ YIRSPFTFGQ GTKVEIKR

BMS2h-733 (SEQ ID NO: 1138)
DIQMTQSPSS LSASVGDRVT ITCRASQSIG AALNWYQQKP
GKAPKLLIYG LSSLQSGVPS RFSGSGSGTD FTLTISSLQP
EDFATYYCQQ LFRLPLTFGQ GTKVEIKR

BMS2h-734 (SEQ ID NO: 1139)
DIQMTQSPSS LSASVGDRVT ITCRASQPIG GRLVWYQQKP
GKAPKLLIYG SSILQSGVPS RFSGSGSGTD FTLTISSLQP
EDFATYYCQQ YAEAPITFGQ GTKVEIKR

BMS2h-735 (SEQ ID NO: 1140)
DIQMTQSPSS LSASVGDRVT ITCRASQNIG SSLIWYQQKP
GKAPTLLIYY SSKLQSGVPS RFSGSGSGTD FTLTISSLQP
EDFATYYCQQ SLSSPYTVGQ GTKVEIKR

BMS2h-736 (SEQ ID NO: 1141)
DIQMTQSPSS LSASVGDRVT ITCRASQWIG SELAWYQQKP
GKAPKLLIYW TSNLQSGVPS RFSGSGSGTD FTLTISNLQP
EDFATYYCQQ ILETPLTFGQ GTKVEIKR

BMS2h-737 (SEQ ID NO: 1142)
DIQMTQSPSS LSASVGDRVT ITCRASQKIW DALYWYQQKP
GKAPKLLIYR GSILQSGVPS RFSGSGSGTD FTLTISSLQP
EDFATYYCQQ FYRWPHTFGQ GTKVEIKR

BMS2h-738 (SEQ ID NO: 1143)
DIQMTQSPSS LSASVGDRVT ITCRASQHIE DSLRWYQQKP
GKAPKLLIYY GSVLQSGVPS RFSGSGSGTD FTLTISSLQP
EDFATYYCQQ MYKFPITFGQ GTKVEIKR

BMS2h-739 (SEQ ID NO: 1144)
DIQTTQSPSS LSASVGDRVT ITCRASQRIN SSLLWYQQKP
GKAPKLLIYD TSTLQSGVPS RFSGSRSGTD FTLTISSLQP
EDFATYYCQQ IWGSPPTFGQ GTKVEIKR

BMS2h-740 (SEQ ID NO: 1145)
DIQMTQSPSS LSASVGDRVT ITCRASQSIP VGLNWYQQKP
GKAPRLLIYS GSTLQSGVPS RFSGSGSGTD FTLTISSLQP
EDFATYYCQQ DWYYPNTFGQ GTKVEIKR

BMS2h-785 (SEQ ID NO: 1146)
DIQMTQSPSS LSASVGDRVT ITCRASQPIY GWLNWYQQKP
GKAPKLLIYL TSGLQSGVPS RFSGSGSGTD FTLTISSLQP
EDFATYYCQQ IHSSPFTFGQ GTKVEIKR

BMS2h-8 (SEQ ID NO: 1147)
DIQMTQSPSS LSASVGDRVT ITCRASQFID TSLEWYQQKP
GKAPKLLIYD GSHLQSGVPS RFSGSGSGTD FTLTISSLQP
EDLATYYCQQ YWVLPLTFGQ GTKVEIKR

BMS2h-86 (SEQ ID NO: 1148)
DIQMTQSPSS LSASVGDRVT ITCRASQDIG DALFWYQQKP
GKAPKLLIYY SSMLQSGVPS RFSGGGSGTD FTLTISSLQP
EDFATYYCQQ RHSTPATFGQ GTKVEIKR

BMS2h-87 (SEQ ID NO: 1149)
DIQMTQSPSS LSASVGDRVT ITCRASQDID ESLMWYQQKP
GKAPRLLIYG VSYLQSGVPS RFSGSGSGTD FTLTISSLQP
EDFATYYCQQ RWKAPFTFGQ GTKVEIKR

BMS2h-88 (SEQ ID NO: 1150)
DIQMTQSPSS LSASVGDRVT ITCRASQEIV EDLYWYQQKP
GKAAKLLIYG ASWLQSGVPS RFSGSGSGTD FTLTISSLQP
EDFATYYCQQ TRRRPYTFGQ GTKVEIKR

BMS2h-89 (SEQ ID NO: 1151)
DIQMTQSPAS LSASVGDRVT ITCRASQDID PMLRWYQQKP
GKAPKLLIYA GSILQSGVPS RFSGSGSGTD FTLTISSLQP
EDFATYYCQQ TLVTPYTFGQ GTKVEIKR

BMS2h-90 (SEQ ID NO: 1152)
DIQMTQSPSS LSASVGDRVT ITCRASQSIS DALFWYQQKP
GKAPRLLIYY GSVLQSGVPS RFSGSGSGTD FTLTISSLQP
EDFATYYCQQ RFQEPVTFGQ GTKVEIKR

BMS2h-91 (SEQ ID NO: 1153)
DIQMTQSPSS LSASVGDRVT ITCRASQQIS DELNWYQQKP
GKAPKLLIYA VSILQSGVPS RFSGSGSGTD FTLTISSLQP
EDFATYYCQQ WLSFPSTFGQ GTKVEIKR

TABLE 4

Human Anti-CD40L VK Domain Encoding Nucleotide Sequences

BMS2h-100 (SEQ ID NO: 1154)
GACATCCAGATGACCCAGTCTCCATCCTCCCTGTCTGCATCTGTAGGAGA
CCGTGTCACCATCACTTGCCGAGCAAGTCAGAATATTAAGCATTCGTTAC
GGTGGTACCAGCAGAAACCAGGGAAAGCCCCTAGGCTCCTGATCTATCAT
CGTTCCCAGTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTCAACAGGTTAGGCATCGTCCTTATACGTTCGGCCAA
GGGACCAAGGTGGAAATCAAACGG

BMS2h-101 (SEQ ID NO: 1155)
GACATCCAGATGACCCAGTCTCCATCCTCTCTGTCTGCATCTGTAGGAGA
CCGTGTCACCATCACTTGCCGGGCAAGTCAGGCTATTGGGCATCGGTTAC
GTTGGTATCAGCAGAAACCAGGGAAAGCCCCTAAGCTCCTGATCTATCAT
CGGTCCAAGTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTCAACAGGTTGCTTTGTTTCCCTATACGTTCGGCCAA
GGGACCAAGGTGGAAATCAAACGG

BMS2h-102 (SEQ ID NO: 1156)
GACATCCAGATGACCCAGTCTCCATCCTCCCTGTCTGCATCTGTAGGAGA
CCGTGTCACCATCACTTGCCGGGCAAGTCAGCATATTGGTCATCATTTAA
GGTGGTACCAGCAGAAACCCAGGGAAAGCCCCAAGCTCCTGATCTATCAT
AGGTCCCATTTGCAAAGTGGGGTCCCATCACGTTTCAGTGGCAGTGGATC
TGGGACAGATTTCACTCTCACCATCAGCAGTCTGCAACCTGAAGATTCTG
CTACGTACTACTGTCAACAGTGGGATAGGCCGCCTTATACGTTCGGCCAA
GGGACCAAGGTGGAAATCAAACGG

BMS2h-103 (SEQ ID NO: 1157)
GACATCCAGATGACCCAGTCCCCATCCTCCCTGTCTGCATCTGTAGGAGA
CCGTGTCACCATCACTTGCCGGGCAAGTCAGGCTATTGGGCATCGGTTAC
GTTGGTATCAGCAGAAACCAGGGAAAGCCCCTAAGCTCCTGATCTATCAT
CGGTCCAAGTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTCAACAGGTGCGGGCTGTGCCTTATACGTTTGGCCAA
GGGACCAAGGTGGAAATTAAACGG

BMS2h-104 (SEQ ID NO: 1158)
GACATCCAGATGACCCAGTCTCCATCCTCCCTGTCTGCATCTGTAGGAGA
CCGTGTCACCATCACTTGCCGGGCAAGTCAGGCTATTGGGCATCGGTTAC
GTTGGTATCAGCAGAAACCAGGGAAAGCCCCTAAGCTCCTGATCTATCAT
CGGTCCAAGTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTCAACAGGTTCGTTTTTCTCCTTATACGTTCGGCCAA
GGGACCAAGGTGGAAATCAAACGG

BMS2h-105 (SEQ ID NO: 1159)
GACATCCAGATGACCCAGTCTCCATCCTCCCTGTCTGCATCTGTAGGAGA
CCGTGTCACCATCACTTGCCGGGCAAGTCAGGCTATTGGGCATCGGTTAC
GTTGGTATCAGCAGAAACCAGGGAAAGCCCCTAAGCTCCTGATCTATCAT
CGGTCCAAGTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTCAACAGTCTTATGCTAGGCCTGTGACGTTCGGCCAA
GGGACCAAGGTGGAAATCAAACGG

BMS2h-106 (SEQ ID NO: 1160)
GACATCCAGATGACCCAGTCTCCATCCTCCCTGTCTGCATCTGTAGGAGA
CCGTGTCACCATCACTTGCCGGGCAAGTCAAAGTATTAATCATAGGTTAT
ATTGGTACCAGCAGAAACCAGGGAAAGCCCCTAAGCTCCTGATCTATCAT
CGGTCCAAGTTGCAAAGTGGGGTCCCATCACGTTTCAGTGGCAGTGGATC
TGGGACAGATTTCACTCTCACCATCAGCAGTCTGCAACCTGAGGATTTTG
CTACGTACTACTGTCAACAGTATAAGGTTAGGCCTAATACGTTCGGCCAA
GGGACCAAGGTGGAAATCAAACGG

BMS2h-107 (SEQ ID NO: 1161)
GACATCCAGATGACCCAGTCTCCATCCTCCCTGTCTGCATCTGTAGGAGA
CCGTGTCACCATCACTTGCCGGGCAAGTCAGGCTATTGGGCATCGGTTAC
GTTGGTATCAGCAGAAACCAGGGAAAGCCCCTAAGCTCCTGATTTATCAT
CGGTCCAAGTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTCAACAGACTTATTCGTCCTCATACGTTCGGCCAA
GGGACCAAGGTGGAAATCAAACGG

BMS2h-108 (SEQ ID NO: 1162)
GACATCCAGATGACCCAGTCTCCATCCTCCCTGTCTGCATCTGTAGGAGA
CCGTGTCACCATCACTTGCCGGGCAAGTCAGGCTATTGGGCATCGGTTAC
GTTGGTATCAGCAGAAACCAGGGAAAGCCCCTAAGCTCCTGATCTATCAT
CGGTCCAAGTTGCAAAGTGGGGTCCCATCACGTTTCAGTGGCAGTGGATC
TGGGACAGATTTCACTCTCACCATCAGCAGTCTACAACCTGAAGATTTTG
CTACGTACTACTGTCAACAGAGGGCGGTGAGGCCTTTTACGTTCGGCCAA
GGGACCAAAGTGGAAATCAAACGG

BMS2h-109 (SEQ ID NO: 1163)
GACATCCAGATGACCCAGTCTCCATCCTCCCTGTCTGCATCTGTAGGAGA
CCGTGTCACCATCACTTGCCGGGCAAGTCAGGCTATTGGGCATCGGTTAC
GTTGGTATCAGCAGAAACCAGGGAAAGCCCCTAAGCTCCTGATCTATCAT
CGGTCCAAGTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTCAACAGACTTATTATCGTCCTCTTACGTTCGGCCAA
GGGACCAAGGTGGAAATCAAACGG

BMS2h-110 (SEQ ID NO: 1164)
GACATCCAGATGACCCAGTCTCCAGCCTCCCTGTCTGCATCTGTAGGAGA
CCGTGTCACCATCACTTGCCGGGCAAGTCAGGATATTGATCCTATGTTAA
GGTGGTACCAGCAGAAACCAGGGAAAGCCCCTAAGCTCCTGATCTATGCG
GGTTCCATTTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTCAACAGACTAGTATTAGGCCTTATACGTTCGGCCAA
GGGACCAAGGTGGAAATCAAACGG

BMS2h-116 (SEQ ID NO: 1165)
GACATCCAGATGACCCAGTCTCCATCCTCCCTGTCTGCATCTGTAGGAGA
CCGTGTCACCATCACTTGCCGGGCAAGTCAGCCTATTGGTCCTGATTTAC
TGTGGTACCAGCAGAAACCAGGGAAAGCCCCTAAGCTCCTGATCTATCAG
ACGTCCATTTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTCAACAGTATTGGCTTTTCCTGTGACGTTCGGCCAA
GGGACCAAGGTGGAAATCAAACGG

BMS2h-116-1 (SEQ ID NO: 1166)
GACATCCAGATGACCCAGTCTCCATCCTCCCTGTCTGCATCTGTAGGAGA
CCGTGTCACCATCACTTGCCGGGCAAGTCAGCCTATTGGTCCTGATATAC
TGTGGTACCAGCAGAAACCAGGGAAAGCCCCTAAGCTCCTGATCTATCAG
ACGTCCATCTTGCAAAGTGGGGTCCCATCACGTTTCAGTGGCAGTGAATC
TGGGACAGATTTCACTCTCACCATCAGCAGTCTGCAACCTGAAGATTTTG
CTACGTACTACTGTCAACAGTATTGGCTTTTCCTGTGACGTTCGGCCAA
GGGACCAAGGTGGAAATCAAACGG

BMS2h-116-10 (SEQ ID NO: 1167)
GACATCCAGATAACCCAGTCTCCATCCTCCCTGTCTGCATCTGTAGGAGA
CCGTGTCACCATCACTTGCCGGGCAAGTCAGCCTATTGGTCCTGATTTAC
TGTGGTACCAGCAGAAACCAGGGAAAGCCCCTAAGCTCCTGATCTATCAG
ACGTCCATATTGCGAAGTGGAGTCCCATCACGTTTCAGTGGCAGTGGGTC
TGGGACAGATTTCACTCTCACCATCAGCAGTCTGCAACCTGAAGATCTTG
CTACGTACTACTGTCAACAGTATTGGCTTTTCCTGTGACGTTCGGCCAA
GGGACCAAGGTGGAAATCAAACGG

BMS2h-116-11 (SEQ ID NO: 1168)
GACATCCAGATGACCCAGTCTCCATCCTCCCTGTCTGCATCTGTAGGAGA
CCGTGTCACCATCACTTGCCGGGCAAGTCAGCCTATTGGTCCTGATTTAC
TGTGGTACCAGCAGAAACCAGGGAAAGCCCCTAAGCTTCTGATCTATCAG
ACGTCCATTTTGCGAAGTGGGTCCCATCACGTTTCAGTGGCAGTGGATC
TGGGACAGATTTCACTCTCACCATCAGCAGTCTGCAACCTGAAGATTTTG
CTACGTACTACTGTCAACAGTATTGGCTTTTCCTGTGACGTTCGGCCAA
GGGACCAAGGTGGAAATCAAACGG

BMS2h-116-12 (SEQ ID NO: 1169)
GACATCCAGATGACCCAGTCTCCATCCTCCCTGTCTGCATCTGTAGGAGA
CCGTGTCACCATCACTTGCCGGGCAAGTCAACCTATTGGTCCTGATTTAC
TGTGGTACCAGCAGAAACCAGGGAAAGCCCCTAAGCTCTTGATCTATCAG
ACGTCCATTTTGCGAAGTGGGGTCCCATCACGTTTCAGTGGCAGCGGATC
TGGGACTGATTTCACTCTCACCATCAGCAGTCTGCAACCTGAAGATTTTG
CTACGTACTACTGTCAACAGTATTGGACTTTTCCTGTGACGTTCGGCCAA
GGGACCAAGGTGGAAATCAAACGG

BMS2h-116-13 (SEQ ID NO: 1170)
GACATCCAGATGACCCAGTCTCCATCCTCCCTGTCTGCATCTGTAGGAGA
CCGTGTCACCATCACTTGCCGGGCAAGTCAGCCTATTGGTCCTGATTTAC
TGTGGTACCAGCAGAAACCAGGGAAAGCCCCTAAGCTCCTGATCTATCAG
ACGTCCATTTTGCGAAGTGGGGTCCCATCACGTTTCAGTGGCAGTGGATC
TGAGACAGATTTCACTCTCACCATCAGCAATCTGCAACCTGAAGATTTTG
CTACGTACTACTGTCAACAGTATTGGCTTTTCCTGTGACGTTCGGCCAA
GGGACCAAGGTGGTAATCAAACGG

TABLE 4-continued

Human Anti-CD40L VK Domain Encoding Nucleotide Sequences

BMS2h-116-1312 (SEQ ID NO: 1171)
GACATCCAGATGACCCAGTCTCCATCCTCCCTGTCTGCATCTGTAGGAGA
CCGTGTCACCATCACTTGCCGGGCAAGTCAGCCTATTGGTCCTGATTTAC
TGTGGTACCAGCAGAAACCAGGGAAAGCCCCTAAGCTCCTGATCTATCAG
ACGTCCATTTTGCGAAGTGGGGTCCCATCACGTTTCAGTGGCAGTGGATC
TGAGACAGATTTCACTCTCACCATCAGCAATCTGCAACCTGAAGATCTTG
CTACGTACTACTGTCAACAGTATTGGGCTTTTCCTGTGACGTTCGGCAAA
GGGACCAAGGTGGTAATCAAACGG

BMS2h-116-1313 (SEQ ID NO: 1172)
GACATCCAGATGACCCAGTCTCCATCCTCCCTGTCTGCATCTGTAGGAGA
CCGTGTCACCATCACTTGCCGGGCAAGTCAGCCTATTGGTCCTGATTTAC
TGTGGTACCAGCAGAAACCAGGGAAAGCCCCTAAGCTCCTGATCTATCAG
ACGTCCATTTTGCGAAGTGGGGTCCCATCACGTTTCAGTGGCAGTGGATC
TGAGACAGATTTCACTCTCACCATCAGCAATCTGCAACCTGAAGATTTTG
CTACGTACTACTGTCAACAGTATTGGGCTTTTCCTGTGACGTTCGGCCGA
GGGACCAAGGTGGTAATCAAACGG

BMS2h-116-1314 (SEQ ID NO: 1173)
GACATCCAGATGACCCAGTCTCCATCCTCCCTGTCTGCATCTGTAGGAGA
CCGTGTCACCATCACTTGCCGAGCAAGTCAGCCTATTGGTCCTGATTTAC
TGTGGTACCGGCAGAAACCAGGGAAAGCCCCTAAGCTCCTGATCTATCAG
ACGTCCATTTTGCGAAGTGGTGTCCCATCACGTTTCAGTGGCAGTGGATC
TGAGACAGATTTCACTCTCACCATCAGCAATCTGCAACCTGAAGATTTTG
CTACGTACTACTGTCAACAGTATTGGGCTTTTCCTGTGACGTTCGGCCAA
GGGACCAAGGTGGTAATCAAACGG

BMS2h-116-1319 (SEQ ID NO: 1174)
GACATCCAGATGACCCAGTCTCCATCCTCCCTGTCTGCATCTGTAGGAGA
CCGTGTCACCATCACTTGCCGGGCAAGTCAGCCTATTGGTCCTGATTTAC
TGTGGTACCAGCAGAAACCAGGGAAAGCCCCTAAGCTCCTGATCTATCAG
ACGTCCATTATGCGAAGTGGGGTCCCATCACGTTTCAGTGGCAGTGGATC
TGAGACAGATTTCACTCTCACCATCAGCAATCTGCAACCTGAAGATTTTG
CTACGTACTACTGTCAACAGTATTGGACTTTTCCTGTGACGTTCGGCCAA
GGGACCAAGGTGGAAATCAAACGG

BMS2h-116-1320 (SEQ ID NO: 1175)
GACATCCAGATGACCCAGTCTCCATCCTCCCTGTCTGCATATGTAGGAGA
CCGTGTCACCATCACTTGCCGGGCAAGTCAGCCTATTGGTCCTGATTTAC
TTTGGTACCAGCAGAAACCAGGGAAAGCCCCTAAGCTCCTGATCTATCAG
ACGTCCATTTTGCGAAGTGGGGTCCCATCACGTTTCAGTGGCAGTGGATC
TGAGACAGATTTCACCCTCACCATCAGCAATCTGCAACCTGAAGATTTTG
CTAAGTACTACTGTCAACAGTATTGGCTTTTCCTGTGACGTTCGGCCAA
GGGACCAAGGTGGTGATCAAACGG

BMS2h-116-138 (SEQ ID NO: 1176)
GACATCCAGATGACCCAGTCTCCATCCTCCCTGTCTGCATCTGTAGGAGA
CCGTGTCACCATCACTTGCCGGGCAAGTCAGCCTATTGGTCCTGATTTAC
TGTGGTACCAGCAGAAACCAGGGAAAGCCCCTAAGCTCCTGATCTATCAG
ACGTCCATTTTGCGAAGTGGGTCCCATCACGTTCAGTGGCAGTGGATCT
TGAGACAGATTTCACTCTCACCATCAGCAATCTGCAACCTGTAGATTTTG
CTACGTACTACTGTCAACAGTATTGGGCTTTTCCTGTGACGTTCGGCCAA
GGGACCAAGGTAGTAATCAAACGG

BMS2h-116-14 (SEQ ID NO: 1177)
GACATCCAGATGACCCAGTCTCCATCCTCCCTGTCTGCATCTGTAGGAGA
CCGTGTCACCATCACTTGCCGGGCAAGTCAGCCTATTGGTCCTGATTTAC
TGTGGTTCCAGCAGAAACCAGGGAAAGCCCCTAAGCTCCTGATCTATCAG
ACGTCCATTTTGCAAAGTGGGGTCCCATCACGTTTCAGTGGCAGTGAATC
TGGGACAGATTTCACTCTCACCATCAGCAGTCTGCAACCTGAAGATTTTG
CTACGTACTACTGTCAACAGTATTGGGCTTTTCCTGTGACGTTCGGCCAA
GGGACCAAGGTGGGAATCAAGCGG

BMS2h-116-15 (SEQ ID NO: 1178)
GACATCCAGATGACCCAGTCTCCATCCTCCCTGTCTGCATCTGTAGGAGA
CCGTGTCACCATCACTTGCCGGGCAAGTCAGCCTATTGGTCCTGATTTAC
TGTGGTACCGGCAGAAACCAGGGAAAGCCCCTAAGCTCCTGATCTATCAG
ACGTCCATTTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTCAACAGTATTGGACTTTTCCTGTGACGTTCGGCCAA
GGGACCAAGGTGGAAATCAAACGG

BMS2h-116-16 (SEQ ID NO: 1179)
GACATCCAGATGACCCAGTCTCCATCCTCCCTGTCTGCATCTGTAGGAGA
CCGTGTCACCATCACTTGCCGGGCAAGTCAGCCTATTGATCCTGACTTAC
TGTGGTACCAGCAGAAACCAGGTAAAGCCCCTAAGCTCCTGATCTATCAG
ACGTCCATTTTGCAAAGTGGGGTCCCATCACGTTTCAGTGGCAGTGGATC
TGGGACAGTTTTCACTCTCACCATCAGCAGTCTGCAACCTGAAGATTTTG
CTACGTACTACTGTCAACAGTATTGGGCATTTCCTGTGACGTTCGGCCAA
GGGACCAAGGTGGAAATCAAACGG

BMS2h-116-17 (SEQ ID NO: 1180)
GACATCCAGATGACCCAGTCTCCATCCTCCCTGTCTGCATCAGTAGGAGA
CCGTGTCACCATCACTTGCCGGGCAAGTCAGCCTATTGGTCCTGATTTAC
TGTGGTACCAGCAGAAGCCAGGGAAAGCCCCTAAGCTCCTGATCTATCAG
ACGTCCATTTTGCGAAGTGGGGTCCCATCACGTTTCAGTGGCAGTGGATC
TGGGACAGATTTCACTCTCACCATCAGCAGTCTGCAACCTGAAGATTTTG
CTACGTACTACTGTCAACAGTATTGGGCTTTTCCTGTGACGTTCGGCCAA
GGGACCAAGGTGGAAATCAAACGG

BMS2h-116-2 (SEQ ID NO: 1181)
GACATCCAGATGACCCAGTCTCCATCATCCCTGTCTGCATCTGTAGGAGA
CCGTGTCACCATCACTTGCCGGGCAAGTCAGCCTATTGAACCTGATTTAC
TGTGGTACCAGCAGAAACCAGGGAAAGCCCCTAAGCTCCTGATCTATCAG
ACGTCCATTTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTCAACAGTATTGGGCTTCTCCTGTGACGTTCGGCCAA
GGGACCAAGGTGGAAATCAAACGG

BMS2h-116-3 (SEQ ID NO: 1182)
GACATCCAGATGACCCAGTCACCATCCTCCCTGTCTGCATCTGTAGGAGA
CCGTGTCACCATCACTTGCCGGGCTAGTCAGCCTATTGGTCCTGATTTAC
TGTGGTACCAGCAGAAACCAGGGAAAGCCCCTAAGCTCCTGATCTATCAG
ACGTCCATTTTGCAAAGTGGGGTCCCATCACGTTTCAGCGGCAGTGAATC
CGGGACAGATTTCACTCTCACCATCAGCAGTCTGCAACCTGAAGATATTG
CAACGTACTACTGTCAACAGTATTGGGCTTTTCCTGTGACGTTCGGCCAA
GGGACCAGGGTGGAAATCAAACGG

BMS2h-116-4 (SEQ ID NO: 1183)
GACATCCAGATGACCCAGTCTCCATCCTCCCTGTCTGCATCTGTAGGAGA
CCGTGTCACCATCACTTGCCGGGCAAGTCAGCCTATTGGTCCTGATTTAC
TGTGGTACCAGCAGAAACCAGGGAAAGCCCCTAAGCTCCTGATCTATCAG
ACGTCCATTTTGCAAAGTGGGTCCCTTCACGTTTCAGTGGCAGTGAATC
TGGGACAGATTTCACTCTCACCATCAGCAGTCTGCAACCTGAAGATTTTG
CTACGTACTACTGTCAACAGTATTGGGCTTTTCCTGTGACGTTCGGCCAA
GGGACCAAGGTGGAAATCAAACGG

BMS2h-116-5 (SEQ ID NO: 1184)
GACATCCAGATGACCCAGTCTCCATCCTCCCTGTCTGCATCTGTAGGAGA
CCGTGTCGCCATCACTTGCCGGGCAAGTCAGCCTATTGGTCCTGATATAC
TGTGGTACCAGCAGAAACCAGGGAAAGCCCCTAAGCTCCTGATCTATCAG
ACGTCCATTTTGCGAAGTGGGGTCCCATCACGTTTCAGTGGCAGTGGATC
TGGGACAGATTTCACTCTCACCATCAGCAGTCTGCAACCTGAAGATCTG
CTACGTACTACTGTCAACAGTATTGGGCTTTTCCTGTGACGTTCGGTCAA
GGGACCAAGGTGGAAATCAAACGG

BMS2h-116-6 (SEQ ID NO: 1185)
GACATCCAGATGACCCAGTCTCCATCCTCCCTGTCTGCATCTGTAGGAGA
CCGTGTCACCATCACTTGCCGGGCAAGTCAGCCTATTGGTCCTGATTTAC
TGTGGTACCAGCAGAAACCAGGGAAAGCCCCTAAGCTCCTGATCTATCAG
ACGTCCATTTTGCGAAGTGGGTCCCGTCACGTTTCAGTGGCAGTGGATC
TGTGACAGATTTCACTCTCACCATCAGCAGTCTGCAACCTGAAGATTTTG
CTACGTACTACTGTCAACAGTATTGGGCTTTTCCTGTGACGTTCGGCCAA
GGGACCAAGGTGGGAATCAAGCGG

BMS2h-116-7 (SEQ ID NO: 1186)
GACATCCAGATGACCCAGTCTCCATCCTCCCTGTCTGCATCTGTAGGAGA
CCGTGTCACCATCACTTGCCGGGCAAGTCAGCCTATTGATCCTGATTTAC
TGTGGTACCAGCAGAAACCAGGGAAAGCCCCTAAGCTCCTGATCTATCAG
ACGTCCATTTTGCAAAGTGGGGTCCCATCACGTTTCAGTGGCAGTGGATC
TAGGACAGATTTCACTCTCACCATCAGCAGTCTGCAACCTGAAGATTTTG
CTACGTACTACTGTCAACAGTATTGGGCTTTTCCTGTGACGTTCGGCCAA
GGGACCAAGGTGGAAATCAAACGG

BMS2h-116-8 (SEQ ID NO: 1187)
GACATCCAGATGACCCAGTCTCCATCCTCCCTGTCTGCATCTGTAGGAGA
CCGTGTCACCATCACTTGCCGGGCAAGTCAGCCTATTGGTCCTGATTTAC
TGTGGTACCAGCAGAAACCAGGGAAAGCCCCTAAGCTCCTGATCTATCAG
ACGTCCATTTTGCAAAGTGGGGTCCCATCACGTTTCAGTGGCAGTGGATC
TGGGACAGATTTCACTCTCACCATCAGCGGTCTGCAACCTGAAGATTTTG
CTACGTACTACTGTCAGCAGTATTGGGCTTTTCCTGTGACGTTCGGCCAA
GGGACCAAGGTGGAAATCAAACGG

TABLE 4-continued

Human Anti-CD40L VK Domain Encoding Nucleotide Sequences

BMS2h-116-9 (SEQ ID NO: 1188)
GACATCCAGATGACCCAGTCTCCATCCTCCCTGTCTGCATCTGTAGGAGA
CCGTGTCACCATCACTTGCCGGGCAAGTATGCCTATTGGTCCTGATTTAC
TGTGGTACCAGCAGAAACCAGGGAAGGCCCCTAAGCTCCTGATCTATCAG
ACGTCCATTTTGCGAAGTGGGGTCCCATCACGTTTCAGTGGCAGTGAATC
TGGGACAGATTTCACTCTCACCATCAGCAGTCTGCAACCTGAAGATTTTG
CTACGTACTACTGTCAACAGTATTGGGCTTTTCCTGTGACGTTCGGCCAA
GGGACCAAGGTGGAAATCAAACGG

BMS2h-141 (SEQ ID NO: 1189)
GACATCCAGATGACCCAGTCTCCATCCTCCCTGTCTGCATCTGTAGGAGA
CCGTGTCACCATCACTTGCCGGGCAAGTCAGTGGATTGGGGATACGTTAA
CGTGGTACCAGCAGAAACTAGGGAAAGCCCCTAAGCTCCTGATCTATGGT
GGTTCCGAGTTGCAAAGTGGGGTCCCACCACGTTTCAGTGGCAGTGGATC
TGGGACAGATTTCACTCTCACCATCAGCAGTCTGCAACCTGAAGATTTTG
CTACGTACTACTGTCAACAGTGTATTAGTAGTCCTTGTACGTTCGGCCAA
GGGACCAAGGTGGAAATCAAACGG

BMS2h-142 (SEQ ID NO: 1190)
GACATCCAGATGACCCAGTCTCCATCCTCCCTGTCTGCATCTGTAGGAGA
CCGTGTCACCATCACTTGCCGGGCAAGTCAGTTTATTGGTGATTCTTTAT
CTTGGTACCAGCAGAAACCAGGGAAAGCCCCTAAGCTCCTGATCTATTTT
TCTTCCATTTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTCAACAGTATCATACTTCGCCTACTACGTTCGGCCGA
GGGACCAAGGTGAAAATCAAACGG

BMS2h-143 (SEQ ID NO: 1191)
GACATCCAGATGACCCAGTCTCCATCCTCCCTGTCCGCATCTGTAGGAGA
CCGTGTCACCATCACTTGCCGGGCAAGTCAGACTATTGAGACTAATTTAG
AGTGGTACCAGCAGAAACCAGGGAAAGCCCCTAAGCTCCTGATCTATGAT
TCTTCCCAGTTGCAAAGTGGGGTCCCATCACGTTTCAGTGGCAGTGGATC
TGGGACAGATTTTACTCTCACCATCAGCAGTCTGCAACCTGAAGATTTAG
CTACGTACTACTGTCAACAGTATCATGGGTATCCTACGACGTTCGGCCAA
GGGACCAAGGTGGAAATCAAACGG

BMS2h-144 (SEQ ID NO: 1192)
GACATCCAGATGACCCAGTCTCCATCCTCCCTGTCTGCATCTGTAGGAGA
CCGTGTCACCATCACTTGCCGGGCAAGTCAGATGATTGATGATTTTAG
AGTGGTACCAGCAGAAACCAGGGAAAGCCCCTAAGCTCCTGATCTATAAT
GCGTCCTGGTTGCAAAGTGGGGTCCCATCACGTTTCAGCGGCAGTGGATC
TGGGACAGATTTCACTCTCACCATCAGCAGTCTGCAACCTGAAGATTTTG
CTACGTACTACTGTCAACAGTATCATGGTTATCCTATTACGTTCGGCCAA
GGGACCAAGGTGGAAATCAAACGG

BMS2h-145 (SEQ ID NO: 1193)
GACATCCAGATGACCCAGTCTCCATCCTCCCTGTCTGCATCTGTAGGAGA
CCGTGTCACCATCACTTGCCGGGCAAGTCAGACGATTTATACTTCGTTAA
GTTGGTATCAGCAGAAACCAGGGAAAGCCCCTAAGCTCCTGATCCATTAT
GGTTCCGTGTTGCAAAGTGGGGTCCCATCACGTTTCAGTGGCAGTGGATC
TGGGACAGATTTCACTCTCACCATCAGCAGTCTGCAACCTGAAGATTCTG
CTACGTACTACTGTCAACAGGTTCATCAGGCTCCTACGACGTTCGGCCAA
GGGACCAAGGTGGAAATCAAACGG

BMS2h-146 (SEQ ID NO: 1194)
GACATCCGGATGACCCAGTCTCCATCCTCCCTGTCTGCATCTGTAGGAGA
CCGTGTCACCATCACTTGCCGGGCAAGTCAGTGGATTGGGGATTCTTTAG
CGTGGTACCAGCAGAAGCCAGGGAAAGCCCCTAAGCTCCTGATCTATGGT
ATTTCCGAGTTGCAAAGTGGGGTCCCATCACGTTTCAGTGGCAGTGGATC
TGGGACAGATTTCACTCTCACCATCAGCAGTCTGCAACCTGAAGATTCTG
CTACGTACTACTGTCAACTGTCTAGTAGTATGCCTCATACGTTCGGCCAA
GGGACCAAGGTGGAAATCAAACGG

BMS2h-147 (SEQ ID NO: 1195)
GACATCCAGATGACCCAGTCTCCATCCTCCCTGTCTGCATCTGTAGGAGA
CCGTGTCACCATCACTTGCCGGGCAAGTCAGGAGATTGAGACGAATTTAG
AGTGGTACCAGCAGAAACCAGGGAAAGCCCCTAAGCTCCTGATCTATGAT
TCGTCCCATTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTCAACAGTATCATCAGAATCCTCCGACGTTCGGCCAA
GGAACCAAGGTGGAAATCAAACGG

BMS2h-149 (SEQ ID NO: 1196)
GACATCCAGATGACCCAGTCTCCATCCTCCCTGTCTGCATCTGTAGGAGA
CCGTGTCACCATCACTTGCCGGGCAAGTCAGTGGATTGGGAGGCAGTTAG
TTTGGTACCAGCAGAAACCAGGGAAAGCCCCTAAGCTCCTGATCTATGGG
GCGACCGAGTTGCAAAGTGGGGTCCCATCACGTTTTAGTGGCAGTGGATC
TGGGACAGATTTCACTCTCACCATCAGCAGTCTGCAACCTGAAGATTTTG
CTACGTACTACTGTCAACAGCAGTCGAAGGGTCCTCTTACGTTCGGCCAT
GGGACCAAGGTGGAAATCAAACGG

BMS2h-150 (SEQ ID NO: 1197)
GACATCCAGATGACCCAGTCTCCATCCTCCCTGTCTGCATCTGTAGGAGA
CCGTGTCACCATCACTTGCCGGGCAAGTCAGGGGATTGGTACTGATTTAA
ATTGGTATCAGCAGAAACCAGGGAAAGCCCCTAAGCTCCTGATCTATATG
GGTTCCTATTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTCAACAGATTTATTCTTTTCCTATTACGTTCGGCCAA
GGGACCAAGGTGGAAATCAAACGG

BMS2h-154 (SEQ ID NO: 1198)
GACATCCAGATGACCCAGTCTCCATCCTCCCTGTCTGCATCTGTAGGAGA
CCGTGTCACCATCACTTGCCGGGCAAGTCAGGATATTGAGGAGATGTTAC
ATTGGTATCAGCAGAAACCAGGGAAAGCCCCTAAGCTCCTGATCTATTTT
GGTTCCCTGTTGCAAAGTGGGGTCCCATCACGTTTCAGTGGCAGTAGATC
TGGGACAGATTTCACTCTCACCATCAGCAGTCTGCAACCTGAAGATTTTG
CTACGTACTACTGTCAACAGCATCATACTCGTCCTTATACGTTCGGCCAA
GGGACCAAGGTGGAAATCAAACGG

BMS2h-155 (SEQ ID NO: 1199)
GACATCCAGATGACCCAGTCTCCATCCTCCCTGTCTGCATCTGTAGGAGA
CCGTGTCACCATCACTTGCCGGGCAAGTCAGGATATTGGGATGGATTTAG
AGTGGTACCAGCAGATACCAGGGAAAGTCCCTAAGCTCCTGATCTATGAT
GCGTCCTATTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTCAACAGTATCATAAGCTTCCTGCGACGTTTGGCCAA
GGGACCAAGGTGGAAATCAAACGG

BMS2h-156 (SEQ ID NO: 1200)
GACATCCAGATGACCCAGTCTCCATCCTCCCTGTCTGCATCTGTAGGAGA
CCGTGTCACCATCACTTGCCGGGCAAGTCAGGATATTATGGATAATTTAG
AGTGGTATCAGCAGAAACCAGGGAAAGCCCCTAAGCTCCTGATCTATGCG
GCGTCCTGGTTGCAAAGTGGGGTCCCATCACGTTTCAGTGGCAGTGGATC
TGGGACAGATTCACTCTCACCATCAGCAGTCTGCAACCTGAAGATTTTG
CTACGTACTACTGTCAACAGTATCATAAGTTGCCTGTGACGTTCGGCCAA
GGGACCAAGGTGGAAATCAAACGG

BMS2h-157 (SEQ ID NO: 1201)
GACATCCAGATGACCCAGTCTCCATCCTCCCTGTCTGCATCTGTAGGAGA
CCGTGTCACCATCACTTGCCGGGCAAGTCAGAATATTGGGGATGATTTAG
AGTGGTACCAGCAGAAACCAGGGAATGCCCCTAAGCTCCTGATCTATAGT
GCGTCCCATTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTCAACAGTATTCTAGTTATCCTGTTACGTTCGGCCAA
GGGACCAAGGTGGAAATCAAACGG

BMS2h-158 (SEQ ID NO: 1202)
GACATCCAGATGACCCAGTCTCCATCCTCCCTGTCTGCATCCGTAGGAGA
CCGTGTCACCATCACTTGCCGGGCAAGTCAGCCGATTGATGAGGATTTAG
AGTGGTACCAGCAGAAACCAGGGAATGCCCCTAAGCTCCTGATCTATAGT
GCGTCCTATTTGCAAAGTGGGGTCCCATCACGTTTCAGTGGCAGTGGATC
TGGGACAGATTTCACTCTCACCATCAGCAGACTGCAACCTGAAGATTTTG
CTACGTACTACTGTCAACAGTATCATCTTCTGCCTGCTACGTTCGGCCAA
GGGACCAAGGTGGAAATCAAACGG

BMS2h-159 (SEQ ID NO: 1203)
GACATCCAGATGATCCAGTCTCCATCCTCCCTGTCTGCATCTGTAGGAGA
CCGTGTCACCATCACTTGCCGGGCAAGTCAGGATATTAATGAGGATTTAG
AGTGGTATCAGCAGAAACCAGGGAAAGCCCCTAAGCTCCTGATCTATAAT
GCTTCCATGTTGCAAAGCGGGGTCCCATCACGTTTCAGTGGCAGTGGATC
TGGGACAGATTTCACTCTCACCATCAGCAGTCTGCAACCTAAAGATTTTG
CTACGTACTACTGTCAACAGTATCATACTAATCCTACTACGTTCGGCCAA
GGGACCAAGGTGGAAATCAAACGG

BMS2h-160 (SEQ ID NO: 1204)
GACATCCAGATGACCCAGTCTCCATCCTCCCTGTCTGCATCTGTAGGAGA
CCGTGTCACCATCACTTGCCGGGCAAGTCAGGATATTGAGGCGGATTTAG
AGTGGTACCAGCAGAAACCAGGGAAAGCCCCTAAGCTCCTGATCTATCAT
TCTTCCGAGTTGCAAAGTGGGGTCCCATCACGTTTCAGTGGAAGTGGATC
TGGGACAGATTTCACTCTCACCATCAGCAGTCTGCAACCTGAAGATTTTG
CTACGTACTACTGTCAACAGTATCATATGTCGCCTGTGACGTTCGGCCAA
GGGACCAAGGTGGAAATCAAACGG

TABLE 4-continued

Human Anti-CD40L VK Domain Encoding Nucleotide Sequences

BMS2h-161 (SEQ ID NO: 1205)
GACATCCAGATGACCCAGTCTCCATCCTCCCTGTCTGCATCTGTAGGAGA
CCGTGTCACCATCACTTGCCGGGCAAGTCAGGATATTGATAGTGATTTAG
AGTGGTACCAGCAGAAACCAGGGAAAGCCCCTATGCTCCTGATCTATTCT
TCGTCCGATTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTCAACAGTATCATAGTCTGCCTGTTACGTTCGGCCAA
GGGACCAAGGTGGAAATCAAACGG

BMS2h-162 (SEQ ID NO: 1206)
GACATCCAGATGACCCAGTCTCCATCCTCCCTGTCTGCATCTGTAGGAGA
CCGTGTCACCATCACTTGCCGGGCAAGTCAGGATATTTCGGATGATTTAG
AGTGGTACCAGCAGAAACCAGGGAAAGCCCCTAAGCTCCTGATCTATAAT
TCGTCCTTTTTGCAAAGTGGGGTCCCATCACGTTTCAGTGGCAGTGGATC
TGGGGCAGATTTCACTCTCACCATCAGCAGTCTGCAACCTGAAGATTTTG
CTACGTACTACTGTCAACAGTATCATAGTTTGCCTGTTACGTTCGGCCAA
GGGACCAAGGTGGAAATCAAACGG

BMS2h-163 (SEQ ID NO: 1207)
GACATCCAGATGACCCAGTCTCCATCCTCCCTGTCTGCATCTGTAGGAGA
CCGTGTCACCATCACTTGCCGGGCAAGTCAGGATATTGAGGGTAATTTAG
AGTGGTACCAGCAGAAACCAGGGAAAGCCCCTAAGCTCCTGATCTATGAT
TCGTCCCAGTTGCAAAGTGGGGTCCCATCACGTTTCAGTGGCAGTGGGTC
TGGGACAGATTTCACTCTCACCATCAGCAGTCTGCAACCTGAAGATTTTG
CTACGTACTACTGTCAACAGTATCATCATCTTCCTACGACGTTCGGCCAA
GGGACCAAGGTGGAAATCAAACGG

BMS2h-164 (SEQ ID NO: 1208)
GACATCCAGATGACCCAGTCTCCATCCTCCCTGTCTGCATCTGTAGGAGA
CCGTGTCACCATCACTTGCCGGGCAAGTCAGAGTATTGATACGGATTTAG
AGTGGTATCAGCAGAAACCAGGGAAAGCCCCTAAGCTCCTGATCTATGAT
GGGTCCTGGTTGCAAAGTGGGGTCCCATCACGTTTCAGTGGCAGTGGATC
TGGGACAGATTTTACTCTCACCATCAGCAGTCTGCAACCTGAAGATTTTG
CTACGTACTACTGTCAACAGTATCGGTGGATTCCTGTTACGTTCGGCCAA
GGGACCAAGGTGGAAATCAAACGG

BMS2h-165 (SEQ ID NO: 1209)
GACATCCAGATGACCCAGTCTCCATCCTCCCTGTCTGCATCTGTAGGAGA
CCGTGTCACCATCACTTGCCGGGCAAGTCAGAGTATTAGTACTGATTTAG
AGTGGTACCAGCAGAAACTAGGGAAAGCCCCTAAGCTCCTGATCTATGAT
GCTTCCCTTTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTCAACAGTATTCGAGTCTGCCTGTTACGTTCGGCCAA
GGGACCAAGGTGGAAATCAAACGG

BMS2h-166 (SEQ ID NO: 1210)
GACATCCAGATGACCCAGTCTCCATCCTCCCTGTCTGCATCTGTAGGAGA
CCGTGTCACCATCACTTGCCGGGCAAGTCAGCCTATTACGACGTCTTTAG
AGTGGTACCAGCAGAAACCAGGGAAAGCCCCTAAGCTCCTGATCTATGAT
GCGTCCATGTTGCAAAGTGGGTCCCATCACGTTTCAGTGGCAGTGGATC
TGGGACAGATTTCACTCTCACCATCAGCAGTCTGCAACCTGAAGATTTTG
CTACGTACTACTGTCAACAGTATTGGGTTACGCCTGTTACGTTCGGCCAA
GGGACCAAGGTGGAAATCAAACGG

BMS2h-167 (SEQ ID NO: 1211)
GACATCCAGATGACCCAGTCTCCATCCTCCCTGTCTGCATCTGTAGGAGA
CCGTGTCACCATCACCTGCCGGGCAAGTCAGAATATTCATACGAATTTAG
AGTGGTATCAGCAGAAACCAGGGAAAGCCCCTAAGCTCCTGATCTATGAT
GGTTCCATGTTGCAAAGTGGGTCCCATCACGTTTCAGTGGCAGTGGATC
TGGGACAGATTTCACTCTCACCATCAGCAGTCTGCAACCTGAAGATTTTG
CTACGTACTACTGTCAACAGTATTCGGCTAATCCTGTTACGTTCGGCCAA
GGGACCAAGGTGGGAATCAAACGG

BMS2h-168 (SEQ ID NO: 1212)
GACATCCAGATGACCCAGTCTCCATCCTCCCTGTCTGCATCTGTAGGAGA
CCGTGTCACCATCACTTGCCGGGCAAGTCAGTGGATTCATACGGATTTAG
AGTGGTATCAGCAGAAACCAGGGAAAGCCCCTAAGCTCCTGATCTATGAT
GGTTCCATGTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTCAACAGTATAGTGTGTCGCCTGTTACGTTCGGCCAA
GGGACCAAGGTGGGAATCAAACGG

BMS2h-169 (SEQ ID NO: 1213)
GACATCCAGATGACCCAGTCTCCATCCTCCCTGTCTGCATCTGTAGGAGA
CCGTGTCACCATCACTTGCCGGGCAAGTCAGAGTATTGATAATAATTTAG
AGTGGTACCAGCAGAAACCAGGGGAAGCCCCTAAGCTCCTGATCTATGAT
GGGTCCCTTTTGCAAAGTGGGGTCCCATCACGTTTCAGTGGCAGTGGATC
TGGGACAGATTTCACTCTTACCATCAGCAGTCTGCAACCTGAAGATTTTG
CTACGTACTACTGTCAACAGTATCATCTTCATCCTGTTACGTTCGGCCAA
GGGACCAAGGTGGAAATCAAACGG

BMS2h-170 (SEQ ID NO: 1214)
GACATCCAGATGACCCAGTCTCCATCCTCCCTGTCTGCATCTGTAGGAGA
CCGTGTCACCATCACTTGCCGGGCAAGTCAGGATATTGATACGAATTTAG
AGTGGTATCAGCAGAAACCAGGGGAAGCCCCTAAGCTCCTGATCTATGAT
CGTTCCACGTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTCAACAGTATGATTCTTATCCTGTGACGTTCGGCCAA
GGGACCAAGGTGGAAATCAAACGG

BMS2h-171 (SEQ ID NO: 1215)
GACATCCAGATGACCCAGTCTCCATCCTCCCTGTCTGCATCTGTAGGAGA
CCGTGTCACCATCACTTGCCGGGCAAGTCAGTCTATTGAGTCTAATTTAG
AGTGGTACCAGCAGAAACCAGGGAAAGCCCCTAAGCTCCTGATCTATAAT
GCGTCCGAGTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTCAACAGTATGATCAGTGGCTACGACGTTCGGCCAA
GGGACCAAGGTGGAAATCAAACGG

BMS2h-172 (SEQ ID NO: 1216)
GACATCCAGATGACCCAGTCTCCATCCTCCCTGTCTGCATCTGTAGGAGA
CCGTGTCACTATCACTTGCCGGGCAAGTCAGGCTATTGGTAATACTTTAC
GGTGGTACCAGCAGAAACCAGGGAAAGCCCCTAAGCTCCTGATCTATCTT
AGTTCCAGGTTGCAAAGTGGGGTCCCATCACGTTTCAGTGGCAGTGGATC
TGGGACAGATTTTACTCTCACCATCAGCAGTCTGCAACCTGAAGATTTTG
CTACGTACTACTGTCAACAGCTGAAGAAGCCTCCTTATACGTTCGGCCAA
GGGACCAAGGTGGAAATCAAACGG

BMS2h-173 (SEQ ID NO: 1217)
GACATCCAGATGACCCAGTCTCCATCCTCCCTGTCTGCATCTGTAGGAGA
CCGTGTCACCATCACTTGCCGGGCAAGTCAGAAGATTAAGAATCGGTTAG
CGTGGTACCAGCAGAAACCAGGGAAAGCCCCTAAGCTCCTGATCTATGAG
GTTTCCCATTTGCAAAGTGGGGTCCCATCACGTTTCAGTGGCAGTGGATC
TGGGACAGATTTCACTCTCACCATCGGCAGTCTGCAACCTGAAGATTTTG
CTACGTACTACTGTCAACAGAGGAGGCAGTCGCCTTATACGTTCGGCCAA
GGGACCAAGGTGGAAATCAAACGG

BMS2h-174 (SEQ ID NO: 1218)
GACATCCAGATGACCAGTCTCCATCCTCCCTGTCTGCATCTGTAGGAGA
CCGTGTCACCATCACTTGCCGGGCAAGTGAGGATATTGGGGAGGAGTTAT
TTTGGTATCAGCAGAAACCAGGGAAAGCCCCTAAGCTCCTGATCTATTCG
GCGTCCACGTTGCAAAGTGAGGTCCCATCACGTTTCAGTGGCAGTGGATC
TGGGACAGATTTCACTCTCACCATCGACAGTCTGCAACATGAAGATTTTG
CTACGTACTACTGTCAACAGGTTTATGAGTGGCCTTATACGTTCGGCCAA
GGGACCAAGGTGGAAATCAAACGG

BMS2h-175 (SEQ ID NO: 1219)
GACATCCAGATGACCCAGTCTCCATCCTCCCTGTCTGCATCTGTAGGAGA
CCGTGTCACCATCACTTGCCGGGCAAGTCAGCCTATTTGTGGGGTTTAA
GGTGGTACCAGCAGAAACCAGGGAAAGCCCCTAAGCTCCTGATCTATTCT
ACTTCCATGTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTCAACAGCTTTATTCTGCTCCTTATACGTTCGGCCAA
GGGACCAAGGTGGAAATCAAACGG

BMS2h-305 (SEQ ID NO: 1220)
GACATCCAGATGACCCAGTCTCCATCCTCCCTGTCTGCATCTGTAGGAGA
CCGTGTCACCATCACTTGCCGGGCAAGTCAGGATATTGATCAGGATTTAG
AGTGGTACCAGCAGAAACCAGGGAAAGCCCCTAAGCTCCTGATCTATAAT
GTTTCCTGTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTCAACAGTATTCTATGAATCCTGTTACGTTCGGCCAA
GGGACCAAGGTGGAAATCAAACGG

BMS2h-306 (SEQ ID NO: 1221)
GACATCCAGATGACCCAGTCTCCATCCTCCCTGTCTGCATCTGTAGGAGA
CCGTGTCACCATCACTTGCCGGGCAAGTCAGGATATTGGGAATCAGTTAA
AGTGGTACCAGCAGAAACCAGGGAAAGCCCCTAAGCTCCTGATCTATGAT
GCTTCCGGGTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTCAACAGTATGATTTGAGGCCTCAGACGTTCGGCCAA
GGGACCAAGGTGGAAATCAAACGG

TABLE 4-continued

Human Anti-CD40L VK Domain Encoding Nucleotide Sequences

BMS2h-307 (SEQ ID NO: 1222)
GACATCCAGATGACCCAGTCTCCATCCTTCCTGTCTGCATCTGTAGGTGA
CCGTGTCACCATCACTTGCCGGGCGAGTCAGAAGATTTCTACGTCTTTAG
AGTGGTATCAGCAGAAACCAGGGAAAGCCCCTAGGCTCCTGATCTATGAT
TCTTCCTGGTTGCAAAGTGGGGTCCCATCACGTTTCAGTGGCAGTGGATC
TGGGACAGATTTCACTCTCACCATTAGCAGTCTGCAACCTGAAGATTTTG
CTACGTACTACTGTCAACAGTATGAGTATAATCCTATTACGTTCGGCCAA
GGGACCAAGGTGGAAATCAAACGG

BMS2h-33 (SEQ ID NO: 1223)
GACATCCAGATGACCCAGTCTCCATCCTCCCTGTCTGCATCTGTAGGAGA
CCGTGTCACCATCACTTGCCGGGCAAGTCAGACGATTGGGGAGAGTTTAC
ATTGGTACCAGCAGAAACCAGGGAAAGCCCCTAGGCTCCTGATCTATTTT
GCTTCCTGTTGCAAAGTGGGGTCCCATCGCGTTTCAGTGGCAGTGGATC
TGGGACAGATTTTACTCTCACCATCAGCAGTCTGCAACCTGAAGATTTTG
CTACGTACTACTGTCAACAGCATCATATGCTTCCTTCTACGTTCGGCCAA
GGGACCAAGGTGGAAATCAAACGG

BMS2h-35 (SEQ ID NO: 1224)
GACATCCAAATGACCCAGTCTCCATCCTCCCTGTCTGCATCTGTAGGAGA
CCGTGTCACCATCACTTGCCGGGCAAGTCAGTTTATTGGTGATTCTTTAT
CTTGGTACCAGCAGAAACCAGGGAAAGCCCCTAAGCTCCTGATCTATTTT
TCTTCCATTTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTCAACAGTATATGGATATTCCTATTACGTTCGGCCAA
GGGACCAAGGTGGAAATCAAACGG

BMS2h-36 (SEQ ID NO: 1225)
GACATCCAGATGACCCAGTCTCCATCCTCCCTGTCTGCATCTGTAGGAGA
CCGTGTCACCATCACTTGCCGGGCAAGTCAGGATATTGATCATAATTTAG
AGTGGTATCAGCAGAAACCAGGGAAAGCCCCTAAGCTCCTGATCTATGAT
AGTTCCATGTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTCAACAGTATCATTCTATTCCTGTTACGTTCGGCCAA
GGGACCAAGGTGGAAATCAAACGG

BMS2h-37 (SEQ ID NO: 1226)
GACATCCAGATGACCCAGTCTCCATCCTCCCTGTCTGCATCTGTAGGAGA
CCGTGTCACCATCACTTGCCGGGCAAGTCAGCAGATTGAGACGATTTAG
AGTGGTATCAGCAGAAACCAGGGAAAGCCCCTAAGCTCCTGATCTATGAT
GGTTCCTGGTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTCAACAGTATCATAGTTTGCCTGCTACGTTCGGCCAA
GGGACCAAGGTGGAAATCAAACGG

BMS2h-38 (SEQ ID NO: 1227)
GACATCCAGATGACCCAGTCTCCATCCTCCCTGTCTGCATCTGTAGGAGA
CCGTGTCACCATCACTTGCCGGGCAAGTCAGGATATTGGTAATAATTTAG
AGTGGTACCAGCAGAAACCAGGGAAAGCCCCTAGGCTCCTGATCTATCAT
GGGTCCTGGTTGCAAAGTGGGGTCCCATCGCGTTTCAGTGGCAGTGGATC
TGGGACAGATTTCACTCTTACCATCAGCAGTCTGCAACCTGAAGATTTTG
CTACGTACTACTGTCAACAGTATGATTTTAATCCTACTACGTTCGGCCAA
GGGACCAAGGTGGAAATCAAACGG

BMS2h-39 (SEQ ID NO: 1228)
GACATCCAGATGACCCAGTCTCCATCCTCCCTGTCTGCATCTGTAGGAGA
CTGTGTCACCATCACTTGCCGGGCAAGTCAGAATATTGATGGTCTGTTAT
GGTGGTATCAGCAGAAACCAGGGAAAGCCCCTAAGCTCCTGATCTATGCG
GGGTCCGGGTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTCAACAGAAGGCTTTTGAGCCTTTTACGTTCGGCCAA
GGGACCAAGGTGGAAATCAAACGG

BMS2h-405 (SEQ ID NO: 1229)
GACATCCAGATGACCCAGACTCCATCCTCCCTGTCTGCATCTGTAGGAGA
CCGTGTCACCATCACTTGCCGGGCAAGTCTCAGAGTATTGGTCATGATTTAG
AGTGGTACCAGCAGAAACCAGGGAAAGCCCCTAAGCTCCTGATCTATAAT
GTGTCCTGGTTGCAAAGTGGGGTCCCATCACGTTTCAGTGGCAGTGGATC
TGGGACAGATTTTACTCTCACCATCAGCAGTCTGCAACCTGAAGATTTTG
CTACGTACTACTGTCAACAGTATAGTCATAATCCTCCTACGTTCGGCCAA
GGGACCAAGGTGGAAATCAAACGG

BMS2h-406 (SEQ ID NO: 1230)
GACATCCAGATGACCCAGTCTCCATCCTCCCTGTCTGCATCTGTAGGAGA
CCGTGTCACTATCACTTGCCGGGCAAGTCAGCATATTGAGAATGATTTAG
AGTGGTACCAGCAGAAACCAGGGAAAGCCCCTAAGCTCCTGATCTATTCT
GCTTCCCATTTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTCAACAGTATCATCTTCAGCCTACGACGTTCGGCCCA
GGGACCAAGGTGGAAATCAAACGG

BMS2h-431 (SEQ ID NO: 1231)
GACATCCAGATGACCCAGTCTCCATCCTCCCTGTCTGCATCTGTAGGAGA
CCGTGTCACTATCACTTGCCGGGCAAGTCAGGTTATTGAGGGTAGTTTAA
ATTGGTACCAGCAGAAACCAGGGAAAGCCCCTAAGCTCCTGATCTATCAT
AGGTCCATTTTGCAAAGTGGGGTCCCATCACGTTTCAGTGGCCGTGGATC
TGGGACAGATTTCACTCTCACCATCAGCAGTCTGCAACCTGAAGATTTTG
CTACGTACTACTGTCAACAGACTTATCAGCTTCCTTTGACGTTCGGCCAA
GGGACCAAGGTGGAAATCAAACGG

BMS2h-432 (SEQ ID NO: 1232)
GACATCCAGATGACCCAGTCTCCATCCTCCCTGTCTGCATCTGTAGGAGA
CCGTGTCACCATCACTTGCCGGGCAAGTCGTCCTATTAATGGTAAGTTAT
TTTGGTACCAGCAGAAACCAGGCAAAGCCCCTAAGCTCCTGATCGCGTTT
GCTTCCTGGTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTGTGCAGCAGGCTGTGTATCCTATTACGTTCGGCCAA
GGGACCAAGGTGGAAATCAAACGG

BMS2h-433 (SEQ ID NO: 1233)
GACATCCAGATGACCCAGTCTCCATCCTCCCTGTCTGCATCTGTAGGAGA
CCGTGTCACCATCACTTGCCGGGCAAGTCAGGCTATTGAGACGAATTTAG
AGTGGTATCAGCAGAAACCAGGGAAAGCCCCTAAGCTCCTGATCTATGAT
GGGTCCCTTTTGCAAAGTGGGGTCCCATCACGTTTCAGTGGCAGAGGATC
TGGGACAGATTTCACTCTCACCATCAGCAGTCTGCAACCTGAAGATTTTG
CTACGTACTACTGTCAACAGTATCATTATCAGCCTGCGACGTTCGGCCAA
GGGACCAAGGTGGAAATCAAACGG

BMS2h-434 (SEQ ID NO: 1234)
GACATCCAGATGACCCAGTCTCCATCCTCCCTGTCTGCATCTGTAGGAGA
CCGTGTCACCATCACTTGCCGGGCAAGTCAGGATATTGAGCATGATTTAG
AGTGGTACCAGCAGAAACCAGGGAAAGCCCCTAAGCTCCTGATCTATTCG
GCGTCCCAGTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTCAACAGTATCAGCAGCAGCCTACTACGTTCGGCCAA
GGGACCAAGGTGGAAATCAAACGG

BMS2h-435 (SEQ ID NO: 1235)
GACATCCAGATGACCCAGTCTCCATCCTCCCTGTCTGCATCTGTAGGAGA
CCGTGTCACCATCACTTGCCGGGCAAGTTCGCAGATTGAGGAGTCTTTAT
GGTGGTACCAGCAGAAACCAGGGAAAGCCCCTAAGCTCCTGATCGGGAT
GTTTCCCTGTTGCAAAGTGGAGTCCCATCACGTTTCAGTGGCAGTGGATC
TGGGACAGATTTCACTCTCACCATCAGCAGTCTGCAACCTGAAGATTTTG
CTACGTACTACTGTGCTCAGGGTGTGGTGGAGCCTCGTACGTTCGGCCAA
GGGACCAAGGTGGAAATCAAACGG

BMS2h-436 (SEQ ID NO: 1236)
GACATCCAGATGACCCAGTCTCCATCCTCCCTGTCTGCATCTGTAGGAGA
CCGTGTCACCATCACTTGCCGGGCAAGTCAGTATATTGGTCTGGATTTAG
AGTGGTATCAGCAGAAACCAGGGAAAGCCCCTAAGCTCCTGATCTATGCT
GCTTCCTGGTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTCAACAGTATTTTCGGCAGCCTATTACGTTCGGCCAA
GGGACCAAGGTGGAAATCAAACGG

BMS2h-437 (SEQ ID NO: 1237)
GACATCCAGATGACCCAGTCTCCATCCTCCCTGTCTGCATCTGTAGGAGA
CCGTGTCACCATCACTTGCCGGGCAAGTACGCCGATTGGTACTATGTTAG
ATTGGTACCAGCAGAAACCAGGGAAAGCCCCTAAGCTCCTGATCGGGCAT
TCGTCCTGGTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTGGGCAGCATGCGTCCTCCTGCGACGTTCGGCCAA
GGGACCAAGGTGGAAATCAAACGG

BMS2h-437-1 (SEQ ID NO: 1238)
GACATCCAGTTGACCCAGTCTCCAACCTCCCTGTCTGCAACTGTAGGAGA
CCGTGTCACCATCACTTGCCGGGCAAGTACGCCGATTGGTACTATGTTAG
ATTGGTACCAGCAGAAACCTGGGAAAGCCCCTAAGCTCCTGATCGGGCAT
TCGTCCTGGTTGCAAAGTGGGGTCCCATCACGTTTCAGTGGCAGTGGATC
TGGGACTGATTTCACTCTCACCATCAGCAGTCTGCAACCTGAAGATTTTG
CTACGTACTACTGTGGGCAGCATGTGCGTCATCCTGCGACGTTCGGCCAA
GGGACCAAGGTGGAAATCAAGCGG

TABLE 4-continued

Human Anti-CD40L VK Domain Encoding Nucleotide Sequences

BMS2h-437-2 (SEQ ID NO: 1239)
GACATCCAGATGACCCAGTCTCCATCCTCCCTGTCTGCATCTGTAGGAGA
CCGTGTCACCATCACTTGCCGGGCAAGTACGCCGATTGGTACTATGTTAG
ATTGGTACCAGCAGAAACCAGGGAAAGCCCCTAAGCTCCTGATCGGGCAT
TCGTCCTGGTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTGGACAGCATGTGCGTCCTCCTGCGACGTTCGGCCAA
GGGACCAAGGTGGGAATCAAACGG

BMS2h-437-3 (SEQ ID NO: 1240)
GACATCCAGATGACCCAGTCTCCGTCCTCCCTGTCTGCATCTGTAGGAGA
CCGTGTCACCATCACTTGCCGGGTAAGTACGCCGATTGGTACTATGTTAG
ATTGGTACCAGCAGAAACCAGGGAAAGCCCCTAAGCTCCTGATCGGGCAT
TCGTCCTGGTTGCAAAGTGGGGTCCCACCACGTTTCAGTGGCAGCGGATC
TGGGACAGATTTCACTCTCACCATCAGCAGTCTGCAACCTGAAGATTTTG
CTACGTACTACTGTGGGCAGCATGTGCGTCCTCCTGCGACGTTCGGCCAA
GGGACCAAGGTGGGAATCAAACGG

BMS2h-437-4 (SEQ ID NO: 1241)
GACATCCAGATGACCCAGTCTCCATCCTCCCTGTCTGCATCTGTAGGAGA
CCGTGTCACCATCACTTGCCGGGCAAGTACGCCGATTGGTACTATGTTAG
ATTGGTACCAGCAGAAACCAGGGAAAGCCCCTAAGCTCCTGATCGGGCAT
TCGTCCTGGTTGCAAAGTGGGGTCCCATCACGTTTCAGTGGCTGTGGATC
TGGGACAGATTTCACTCTCACCATCAGCAGTCTGCAACCTGAAGATTTTG
CTACGTACTACTGTGGGCAGCATGTGCGTCCTCCTGCGACGTTCGGCCAA
GGGACCAAGGTGGAAATCAAACGG

BMS2h-437-5 (SEQ ID NO: 1242)
GACATCCAGATGACCCAGTCTCCATCCTCCCTGTCTGCATCTGTAGGAGA
CCGTGTCACCATCACTTGCCGGGCAAGTACGCCGATTGGTACTATGATAG
ATTGGTACCAGCAGAAACCAGGGAAAGCCCCTAAGCTCCTGATCGGGCAT
TCGTCCTGGTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTGGGCAGCATGTGCGTCCTCCTGCGACGTTCGGCAAA
GGGACCAAGGTGGAAATCAAACGG

BMS2h-438 (SEQ ID NO: 1243)
GACATCCAGATGACCCAGTCTCCATCCTCCCTGTCTGCATCTGTAGGAGA
CCGTGTCACCATCACATGCCGGGCAAGTCAGTATATTGATACTAATTTAG
AGTGGTACCAGCAGAAACCAGGGAAAGCCCCTAGGCTCCTGATCTATGAT
GGTTCCCAGTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTCAACAGTATCAGGTTGTGCCTGTTACGTTCGGCCAA
GGGACCAAGGTGGAAATCAAACGG

BMS2h-439 (SEQ ID NO: 1244)
GACATCCAGATGACCCAGTCTCCATCCTCCCTGTCTGCATCTGTAGGAGA
CCGTGTCACCATCACTTGCCGGGCAAGTCAGAGCATTAGCAGCTATTTAA
ATTGGTACCAGCAGAAACCAGGGAAAGCCCCTAGGCTCCTGATCGTGGAT
TCTTCCGGGTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTGGTCAGGATCGTTGGTCTCCTGCTACGTTCGGCCAA
GGGACCAAGGTGGAAATCAAACGG

BMS2h-440 (SEQ ID NO: 1245)
GACATCCAGATGACCCAGTCTCCATCCTCCCTGTCTGCATCTGTAGGAGA
CCGTGTCACCATCACTTGCCGGGCAAGTTCGCGGATTCAGCATATGTTAT
CTTGGTACCAGCAGAAACCAGGGAAAGCCCCTAAGCTCCTGATCGGTGGG
CATTCCGGGTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTGCGCAATGTGTGCGTGGCCTCTGACGTTCGGCCAA
GGGACCAAGGTGGAAATCAAACGG

BMS2h-441 (SEQ ID NO: 1246)
GACATCCAGATGACCCAGTCTCCATCCTCCCTGTCTGCATCTGTAGGAGA
CCGTGTCACCATCACTTGCCGGGCAAGTAGGGGTATTGATGGTGATTTAT
GGTGGTACCAGCAGAAACCAGGGAAAGCCCCTAAGCTCCTGATCGCGGAT
TCTTCCCTGTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTGGGCAGGGGCTGTTCGGCCTATGACGTTCGGCCAA
GGGACCAAGGTGGAAATCAAACGG

BMS2h-442 (SEQ ID NO: 1247)
GACATCCAGATGACCCAGTCTCCATCCTCCCTGTCTGCATCTGTAGGAGA
CCGTGTCACCATCACTTGCCGGGCAAGTAGGGGTATTGATACTGATTTAT
GGTGGTACCAGCAGAAACCAGGGAAAGCCCCTAAGCTCCTGATCGCGGAT
TCTTCCCTGTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTGGGCAGGGGCTGTTCGGCCTATGACGTTCGGCCAA
GGGACCAAGGTGGAAATCAAACGG

BMS2h-443 (SEQ ID NO: 1248)
GACATCCAGATGACCCAGTCTCCATCCTCCCTGTCTGCATCTGTAGGAGA
CCGTGTCACCATCACTTGCCGGGCAAGTTATACTATTCCGGTTGCTTTAG
ATTGGTACCAGCAGAAACCCCCTAAGCTCCTGATCTATGAT
GCGTCCTTGTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTGCGCAGGGTTGGCCGGGGCCTCAGACGTTCGGCCAA
GGGACCAAGGTGGAAATCAAACGG

BMS2h-444 (SEQ ID NO: 1249)
GACATCCAGATGACCCAGTCTCCATCCTCCCTGTCTGCATCTGTAGGAGA
CCGTGTCACCATCACTTGCCGGGCAAGTCAGAGTATTGCGACGGACTTAG
AGTGGTATCAGCAGAAACCAGGGAAAGCCCCTAAGCTCCTGATCTATGAT
ACTTCCATGTTGCAAAGCGGGGTCCCATCACGTTTCAGTGGCAGTGGATC
TGGGACAGATTTCACTCTCACCATCAGCAGTCTGCAACCTGAAGATTTTG
CTACGTACTACTGTCAACAGTATAGTTATAATCCTTCGACGTTCGGCCAA
GGGACCAAGGTGGAAATCAAACGG

BMS2h-445 (SEQ ID NO: 1250)
GACATCCAGATGACCCAGTCTCCATCCTCCCTGTCTGCATCTGTAGGAGA
CCGTGTCACCATCACTTGCCGGGCAAGTGTGCCTATTACTGAGGGTTTAT
CGTGGTACCAGCAGAAACCAGGGAAAGCCCCTAAGCTCCTGATCCAGGCT
AATTCCTGGTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTGGGCAGTGGGAGCATGTTCCTGCGACGTTCGGCCAA
GGGACCAAGGTGGAAATCAAACGG

BMS2h-446 (SEQ ID NO: 1251)
GACATCCAGATGACCCAGTCTCCATCCTCCCTGTCTGCATCTGTAGGAGA
CCGTGTCACCATCACTTGCCGGGCAAGTAGTAGATTCTTTATGGTTTAG
ATTGGTACCAGCAGAAACCAGGGAAAGCCCCTAAGCTCCTGATCGGTGGT
ACTTCCGCGTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTGGTGGGAGACGGTTCCTGCTACGTTCGGCCAA
GGGACCAAGGTGGAAATCAAACGG

BMS2h-447 (SEQ ID NO: 1252)
GACATCCAGATGACCCAGTCTCCATCCTCCCTGTCTGCATCTGTAGGAGA
CCGTGTCACCATCACTTGCCGGGCAAGTCAGCCTATTAATGGGCTTTTAA
TTTGGTATCAGCAGAAACCAGGGAAAGCCCCTAAGCTCCTGATCTATGCG
ATGTCCAGTTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTCAACAGTTGGCTCGGATTCCTTTTACGTTCGGCCAA
GGGACCAAGGTGGAAATCAAACGG

BMS2h-448 (SEQ ID NO: 1253)
GACATCCAGATGACCCAGTCTCCATCCTCCCTGTCTGCATCTGTAGGAGA
CCGTGTCACCATCACTTGCCGAGCAAGTCAGCTGATTCGGACTTATTTAG
CGTGGTACCAGCAGAAACCAGGGAAAGCCCCTAAGCTCCTGATCTATCAG
TCTTCCAGTTGCAAAGTGGTGTCCCATCACGTTTCAGTGGCAGTGGATC
TGGGACAGATTTCACTCTCACCATCAGCAGTCTGCAACCTGAAGATTTTG
CTACGTACTACTGTCAACAGTATAATTCTTATCCTGATACGTTCGGCCAA
GGGACCAAGGTGGAAATCAAACGG

BMS2h-47 (SEQ ID NO: 1254)
GACATCCAGATGACCCAGTCTCCATCCTCCCTGTCTGCATCTGTAGGAGA
CCGTGTCACCATCACTTGCCGGGCAAGTCAGTGGATTGGGGATTCGTTAA
GTTGGTACCAGCAGAAACCAGGGAAAGCCCCTAAGCTCCTGATCTATTTT
GGTTCCTATTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTCAACAGTATTTGCATACTCCTTCGACGTTCGGCCAA
GGGACCAAGGTGGAAATCAAACGG

BMS2h-484 (SEQ ID NO: 1255)
GACATCCAGATGACCCAGTCTCCATCCTCCCTGTCTGCATCTGTAGGAGA
CCGTGTCACCATCACTTGCCGGGCAAGTCAGGATATTGAGGCGGATTTAG
AGTGGTACCAGCAGAAACCAGGGAAAGCCCCTAAGCTCCTGATCTATCAT
TCTTCCGAGTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTCAACAGTATGGTTTTAATCCTCCTACGTTCGGCCAA
GGGACCAAGGTGGAAATCAAACGG

TABLE 4-continued

Human Anti-CD40L VK Domain Encoding Nucleotide Sequences

BMS2h-485 (SEQ ID NO: 1256)
GACATCCAGATGACCCAGTCTCCATCCTCCCTGTCTGCATCTGTAGGAGA
CCGTGTCACCATCACTTGCCGGGCAAGTTCTCCTATTGAGTATGGTTTAG
ATTGGTACCAGCAGAAACCAGGGAAAGCCCCTAAGCTCCTGATCGGGGGG
GGGTCCGCGTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTGGGCAGTGGGAGGTTCAGCCTGCTACGTTCGGCCAA
GGGACCAAGGTGGAAATCAAACGG

BMS2h-486 (SEQ ID NO: 1257)
GACATCCAGATGACCCAGTCTCCATCCTCCCTGTCTGCATCTGTAGGAGA
CCGTGTCACCATCACTTGCCGGGCAAGTCAGCGGATTGATACTGATTTAG
AGTGGTACCAGCAGAAACCAGGGAAAGCCCCTAAGCTCCTGATCTATGAT
AGTTCAGTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTCAACAGTATCATAGTGCGCCTGCGACGTTCGGCCAA
GGGACCAAGGTGGAAATCAAACGG

BMS2h-487 (SEQ ID NO: 1258)
GACATCCAGATGACCCAGTCTCCATCCTCCCTGTCTGCATCTGTAGGAGA
CCGTGTCACCATCACTTGCCGGGCAAGTGGGTGGATTGGTATGTCTTTAG
AGTGGCACCAGCAGAAACCAGGGAAAGCCCCTAAGCTCCTGATCCGTGGG
GCTTCCTCTTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTAGTCAGTCTCGGTGGCCGCCTGTGACGTTCGGCCAA
GGGACCAAGGTGGAAATCAAACGG

BMS2h-488 (SEQ ID NO: 1259)
GACATCCAGATGACCCAGTCTCCATCCTCCCTGTCTGCATCTGTAGGAGA
CCGTGTCACCATCACTTGCCGGGCAAGTCGTAATATTTCGAATGCTTTAT
CGTGGTACCAGCAGAAACCAGGGAAAGCCCCTAAGCTCCTGATCCTTGGG
GCTTCCTGGTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTACTCAGGTGTGGGATAGGCCTTTTACGTTCGGCCAA
GGGACCAAGGTGGAAATCAAACGG

BMS2h-489 (SEQ ID NO: 1260)
GACATCCAGATGACCCAGTCTCCATCCTCCCTGTCTGCATCTGTAGGAGA
CCGTGTCACCATCACTTGCCGGCAAGTCAGGATATTATGTCGGCTTTAT
CTTGGTATCAGCAGAAACCAGGGAAAGCCCCTAAGCTCCTGATCTATTCT
ACTTCCATTTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTCAACAGTTTATTTGCTGCCTGTTACGTTCGGCCAA
GGGACCAAGGTGGAAATCAAACGG

BMS2h-490 (SEQ ID NO: 1261)
GACATCCAGATGACCCAGTCTCCATCCTCCCTGTCTGCATCTGTAGGAGA
CCGTGTCACCATCACTTGCCGGGCAAGTCAGGAGATTGGGATTGATTTAG
AGTGGTATCAGCAGAAACCAGGGAAAGCCCCTAAGCTCCTGATCTATGCT
GCTTCTTATTTGCAAAGTGGGGTCCCATCACGTTTCAGTAGCAGTGGATC
TGGGACAGATTTCACTCTCACCATCAGCAGTCTGCAACCTGAAGATTTTG
CTACGTACTACTGTCAACAGTATGCTTCTAATCCTCCTACGTTCGGCCGA
GGGACCAAGGTGGAAATCAAACGG

BMS2h-491 (SEQ ID NO: 1262)
GACATCCAGATGACCCAGTCTCCATCCTCCCTGTCTGCATCTGTAGGAGA
CCGTGTCACCATCACTTGCCGGGCAAGTCAGATGATTGGGGATTGGTTAA
ATTGGTACCAGCAGAAACCAGGGAAAGCCCCTAAACTCCTGATCTATCGT
AGTTCCGAGTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTCAACAGTTGTATTTTTGGCCTCGTACGTTCGGCCAA
GGGACCAAGGTGGAAATCAAACGG

BMS2h-492 (SEQ ID NO: 1263)
GACATCCAGATGACCCAGTCTCCATCCTCCCTGTCTGCATCTGTAGGAGA
CCGTGTCACCATCACTTGCCGGGCAAGTCAGGCGATTGAGCTTAATTTAG
AGTGGTACCAGCAGAAACCAGGGAAGGCCCCTAAGCTCCTGATCTATGAT
GCTTCCATGTTGCAAAGCGGGGTCCCATCACGTTTCAGTGGCAGTGGATC
TGGGACAGATTTCACTCTCACCATTAGCAGTCTGCAACCTGAAGATTTTG
CTACGTACTACTGTCAACAGTATGATGTTTATCCTCCTACGTTCGGCCAA
GGGACCAAGGTGGAAATCAAACGG

BMS2h-492-1 (SEQ ID NO: 1264)
GACATCCAGATGACCCAGTCTCCATCCTCCCTGTCTGCATCTGTAGGAGA
CCGTGTCACCATCACTTGCCGGGCCAGTCAGGCGATTGAGCATAATTTAG
AGTGGTACCAGCAGAAGCAGGGAAGGCCCCTAAGCTCCTGATCTATGAT
GCTTCCATGTTGCAAAGCGGGGTCCCATCACGTTTCAGTGGCAGTGGATC
TGGGACAGATTTCACTCTCACCATTAGCAGTCTCCAACCTGAAGATTTAG
CTACGTACTACTGTCAACAGTATGATGCTTATCCTCCTACGTACGGCCAA
GGGACCAAGGTGGAAATCAAACGG

BMS2h-492-2 (SEQ ID NO: 1265)
GACATCCAGATGACACAGTCTCCATCCTCCCTGTCCGCATCTGTAGGAGA
CCGTGTCACCATCACTTGCCGGGCAAGTCGGGCGATAGAGACTAATTTAG
AGTGGTACCAGCAGAAACCAGGGAAGGCCCCTAAGCTCCTGTTCTATGAT
GCTTCCATGTTGCAAAGCGGGGTCCCATCACGTTTCGGTGGCAGTGGATC
TGGGACAGATTTCACTCTCACCATTAGCAGTCTGCAACCTGAAGATTTTG
CTACGTACTACTGTCTACAGTATGATGTTTATCCTCCTACGTTCGGCCAA
GGGACCAAGGTGGAAATCAAACGG

BMS2h-492-3 (SEQ ID NO: 1266)
GACATCCAGATGACCCAGTCTCCATCCTCCCTGTCTGCAACTGTAGGAGA
CCGTGTCACCATCACTTGTCGTGCAAGTCAGGCGATTGAGACTAATTTAG
AGTGGTACCAGCAGAAACCAGGGAAGGCCCCTAAGCTCCTGATCTATGAT
GCTTCCATGTTGCAAAGCGGGGTCCCATCACGTTTCAGTGGCAGTGGATC
TGGGACAGACTTCACTCTCACCATTAGCAGTCTGCAACCTGAAGATTTTG
CTACGTACTACTGTCAACAGTATGATGCTTATCCTCCTACGTTCGGCCAA
GGGACCAAGGTGGAAATCAAACGG

BMS2h-492-4 (SEQ ID NO: 1267)
GACATCCAGATGACCCAGTCTCCATCCTCCCTGTCTGCATCTGTAGGAGA
CCGTGTCACCATCACTTGCCGGGCAAGTCAGGCGATTGAGCATAACTTAG
AGTGGTACCAGCAGAAAACCAGGGAAGGCCCCTAAGCTCCTGATCTATGAT
GCTTCCATGTTGCAAAGCGGGGTCCCATCACGTTTCAGTGGCAGAGGATC
TGGGACAGATTTCACTCTCACCATTAGCAGTCTGCAACCTGAAGATTTTG
CTACGTACTACTGTCAACAGTATGATGCTTATCCTCCTACGTTCGGCCAA
GGGACCAAGGTGGAAATCAAACGG

BMS2h-492-5 (SEQ ID NO: 1268)
GACATCCAGATGAACCAGTCTCCATCCTCCCTGTCTGCATCTGTAGGAGA
CCGTGTCTCCATCACTTGCAGGGCAAGTCAGGCTATTGAGCATAATTTAG
AGTGGTACCAGCAGAAAACCAGGGAAGGCCCCTAAGCTCCTGATCTATGAT
GCTTCCATGTTGCAAAGCGGGGTCCCATCACGTTCAGTGGCAGTGGATC
TGGGACAGATTTCACTCTCACCATTAGCAGTCTGCAACCTGAAGATTTTG
CTACGTACTACTGTCAACAGTATGATGCTTATCCTCCTACGTTCGGCCAA
GGGACCAAGGTGGAAATCAAACGG

BMS2h-492-6 (SEQ ID NO: 1269)
GACATCCAGATGACCCAGTCTCCATCCTCCCTGTCTGCATCTGTAGGAGA
CCGTGTCACCATCACTTGCCGGGCAAGTCAGGCGATTGAGTCTAATTTAG
AGTGGTACCAGCAAAAACCAGGGAAGGCCCCTAAGCTCCTGATCTATGAT
GCTTCCATGTTGCAAAGCGGGGTCCCATCACGTTTCAGTGGCAGTGGATC
TGGGACAGATTTCACTCTCACCATTAGCAGTCTGCAACCTGAAGATTTTG
CTACGTACTACTGTCAACAGTATGATGTTTATCCTCCTACGTTCGGCCAA
GGGACCAAGGTGGAAATCAAACGG

BMS2h-492-7 (SEQ ID NO: 1270)
GACATCCAGATGACCCAGTCTCCATCCTCCCTGTCTGCATCTGTAGGAGA
CCGTGTCACCATCACTTGCCGTGCAAGTCAGGCGATTGAGCATAATTTAG
AGTGGTACCAGCAGAAACCAGGGAAGGCCCCTAAGCTCCTGATCTATGAT
GCTTCCATGTTGCAAAGCGGGGTCCCATCACGTTTCAGTGGCAGTGGATC
TGGGACAGATTTCACTCTCACCATTAGCAGTCTGCAACCTGAAGATTTTG
CTACGTACTACTGTCAACAGTATGATGCTTATCCTCCTACGTTCGGCCAA
GGGACCAAGGTGGAAATCAAACGG

BMS2h-493 (SEQ ID NO: 1271)
GACATCCAGATGACCCAGTCTCCATCCTCCCTGTCTGCATCTGTAGGAGA
CCGTGTCACCATCACTTGCCGGGCAAGTCAGGGTATTGATGAGGATTTAG
AGTGGTACCAGCAGAAACCAGGGAAAGCCCCTAGGCTCCTGATCTATTCT
AGTTCCTGGTTGCAAAGTGGGGTCCCATCACGTTTCAGTGGGAGTGGATC
TGGGACAGATTTCACTCTCACCATCAGCAGTCTGCAACCTGAAGATTTTG
CTACGTACTACTGTCAACAGTATTTTCAGTATCCTCCGACGTTCGGCCAA
GGGACCAAGGTGGAAATCAAACGG

BMS2h-494 (SEQ ID NO: 1272)
GACATCCAGATGACCCAGTCTCCATCCTCCCTGTCTGCATCTGTAGGAGA
CCGTGTCACCATCACTTGCCGGGCAAGTCAGAGTATTGATGAGGATTTAG
AGTGGTACCAGCAGAAACCAGGGAAAGCCCCTAGGCTCCTGATCTATTCT
AGTTCCTGGTTGCAAAGTGGGGTCCCATCACGTTTCAGTGGGAGTGGATC
TGGGACAGATTTCACTCTCACCATCAGCAGTCTGCAACCTGAAGATTTTG
CTACGTACTACTGTCAACAGTATTTTCAGTATCCTCCGACGTTCGGCCAA
GGGACCAAGGTGGAAATCAAACGG

TABLE 4-continued

Human Anti-CD40L VK Domain Encoding Nucleotide Sequences

BMS2h-494-1 (SEQ ID NO: 1273)
GACATCCAGATGACCCAGTCTCCATCCTCCCTGTCCGCATCTGTAGGAGA
CCGTGTCACCATCACTTGCAGGGCAAGTCAGAGTATTGATGAGGATTTAG
AGTGGTACCAGCAGAAACCAGGGAAAGCCCCTAGGCTCCTGATCTATTCT
AGTTCCTGGTTGCAAAGTGGGGTCCCATCACGTTTCAGTGGGAGTGGATC
TGGGACAGATTTCACTCTCACCATCAGCAGTCTGCAACCTGAAGATTTTG
CTACGTACTACTGTCAACAGTATTCTCAGTATCCTCCGACGTTCGGCCAA
GGGACCAAGGTGGAAATCAAACGG

BMS2h-494-2 (SEQ ID NO: 1274)
GACATCCAGATGACCCAGTCTCCATCCTCCCTGTCTGCATCTGTAGGAGA
CCGTGTCACCATCACTTGCCGGGCAAGTCAGAGTATTGAAGAGGATTTAG
AGTGGTACCAGCAGAAACCAGGGAAAGCCCCTAGGCTCCTGATCTATTCT
AGTTCCTGGTTGCAAAGCGGGGTCCCATCACGTTTCAGTGGGAGTGGCTC
TGGGACAGATTTCACTCTCACCATCAGCAGTCTGCAACCTGAAGATTTTG
CTACGTACTACTGTCAACAGTATTTTCAGTATCCTCCGACGTTCGGCCAT
GGGACCAAGGTGGAAATCAAACGG

BMS2h-494-3 (SEQ ID NO: 1275)
GACATCCAGATGACCCAGTCTCCATCCTCCCTGTCTGCATCTGTAGGAGA
CCGTGTCACCATCACTTGCCGGGCAAGTCAGAGTATTGATGAGGATTTAG
AGTGGTACCAGCAGAAACCAGGGAAAGCCCCTAGGCTCCTGATCTATTCT
AGTTCCTGGTTGCAAAGTGGGGTCCCATCACGTTTCAGTGGGAGTGGATC
TGGGACAGATTTCACTCTCACCATCAGCAGTCTGCAACCTGAAGATTTTG
CTACGTACTTCTGTCAACAGTATTTTCAGTATCCTCCGACGTTCGGCCAA
GGGACCAAGGTGGAAATCAAACGG

BMS2h-494-4 (SEQ ID NO: 1276)
GAGATCCAGATGACCCAGTCTCCATCCTCCCTGTCTGCATCTGTAGGAGA
CCGTGTCACCATGACTTGCCGGGCAAGTCAGAGTATTGATAAGGATTTAG
AGTGGTACCAGCAGAAACCAGGGAAAGCCCCTAGGCTCCTGATCTATTCT
AGTTCCTGGTTGCAAAGAGGGGTCCCATCACGTTTCAGTGGGAGTGGATC
TGGGACAGATTTCACTCTCACCATCAGCAGTCTGCGACCTGAAGATTTTG
CTACGTACTACTGTCAACAGTATTTTCAGTATCCTCCGACGTTGGGCCAA
GGGACCAAGGTGGAAATCAAACGG

BMS2h-494-5 (SEQ ID NO: 1277)
GACATCCAGATGACCCAGTCTCCATCCTCCCTGTCTGCATCTGTAGGAGA
CCGAGTCACCATCACTTGCCGGGCAAGTCAGAGTATTGATGAGGATTTAG
AGTGGTACCAGCAGAAACCAGGGAAAGCCCCTAGGCTCCTGATCTATTCT
AGTTCCTGGTTGCAAAGTGGGGTCCCATCACGTTTCAGTGGGAGTGGATC
TGGGACAGATTTCACTCTCACCATCAGCGGTCTGCAACCTGAAGATATCG
CTACGTACTACTGTAAACAGTATTCTCAGTATCCTCCGACGTTCGGCCAA
GGGACCAAGGTGGAAATCAAACGG

BMS2h-494-6 (SEQ ID NO: 1278)
GACATCCAGATGACCCAGTCCCCACCCTCCCTGTCTGCATCTGTAGGAGA
CCGTGTCACCATCACTTGCCGGGCAAGTCAGAGTATTGATAAGGATTTAG
AGTGGTACCAGCAGAAACCAGGGAAAGCCCCTAGGCTCCTGATCTATTCT
AGTTCCTGGTTGCAAAGAGGGGTCCCATCACGTTTCAGTGGGAGTGGATC
TGGGACAGATTTCACTCTCACCATCAGCAGTCTGCAACCTGAAGATTTTG
CTACGTACCACTGTCAACAGTATTTTCAGTATCCTCCGACGTTCGGCCAA
GGGACCAAGGTGGAAATCAAACGG

BMS2h-495 (SEQ ID NO: 1279)
GACATCCAGATGACCCAGTCTCCATCCTCCCTGTCTGCATCTGTAGGAGA
CCGTGTCACCATCACTTGCCGGGCAAGTGAGTATATTAATGCTGAGTTAG
CTTGGTATCAGCAGAAACCAGGGAAAGCCCCTAAGCTCCTGATCTATGGG
AGTTCCGGGTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTCTGCAGAATGCGATGTGGCCTATTACGTTCGGCCAA
GGGACCAAGGTGGAAATCAAACGG

BMS2h-496 (SEQ ID NO: 1280)
GACATCCAGATGACCCAGTCTCCATCCTCCCTGTCTGCATCTGTAGGAGA
CCGTGTCACCATCACTTGCCGGGCAAGTCTGGATATTAATAATGGTTTAA
TTTGGTACCAGCAGAAACCAGGGAAAGCCCCTAGGCTCCTGATCTTGGGT
GCGTCCGGTTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTTCGCAGGTGCGTTCTCGGCCTTTTACGTTCGGCCAA
GGGACCAAGGTGGAAATCAAACGG

BMS2h-497 (SEQ ID NO: 1281)
GACATCCAGATGACCCAGTCTCCATCCTCCCTGTCTGCATCTGTAGGAGA
CCGTGTCACCATCACTTGCCGGGCAAGTCAGGATATTCTGAGTGCGTTAG
CTTGGTATCAGCAGAAACCAGGGAAAGCCCCTAAGCTCCTGATCTATGGG
AGTTCCGTTTTGCAAAGTGGGGTCCCATCACGTTTCAGTGGCAGTGGATC
AGGGACAGATTTCACTCTCACCATCAGCAGTCTGCAACCTGAAGATTTTG
CTACGTACTACTGTCAACAGAATTATAGTCTTCCTATTACGTTCGGCCAA
GGGACCAAGGTGGAAATCAAACGG

BMS2h-498 (SEQ ID NO: 1282)
GACATCCAGATGACCCAGTCTCCATCCTCCCTGTCTGCATCTGTAGGAGA
CCGTGTCACCATCACTTGCCGGGCAAGTTCTCCTATTGAGTCGTATTTAA
GGTGGTACCAGCAGAAACCAGGGAAAGCCCCTAAGCTCCTGATCAGGTAT
GTGTCCGTGTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTGGGCAGTGGTTTCGGGCGCCTGTTACGTTCGGCCAA
GGGACCAAGGTGGAAATCAAACGG

BMS2h-499 (SEQ ID NO: 1283)
GACATCCAGATGACCCAGTCTCCATCCTCCCTGTCTGCATCTGTAGGAGA
CCGTGTCACCATCACTTGCCGGGTAAGTGAGTCTATTAATGCTGAGTTAC
ATTGGTACCAGCAGAAACCAGGGAAAGCCCCTAAGCTCCTGATCTCTGGG
TTTTCCGGGTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTGTGCAGTTTGCGATGTGGCCTTTTACGTTCGGCCAA
GGGACCAAGGTGGAAATCAAACGG

BMS2h-500 (SEQ ID NO: 1284)
GACATCCAGATGACCCAGTCTCCATCCTCCCTGTCTGCATCTGTAGGAGA
CCGTGTCACCATCACTTGCCGGGCAAGTATGATGATTAGGTTTGGGTTAG
ATTGGTACCAGCAGAAACCAGGGAAAGCCCCTAAGCTCCTGATCGGTGGT
GGGTCCTCTTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTGGGCAGCATGAGCGGTGGCCTGCTACGTTCGGCCAA
GGGACCAAGGTGGAAATCAAACGG

BMS2h-501 (SEQ ID NO: 1285)
GACATCCAGATGACCCAGTCTCCATCCTCCCTGTCTGCATCTGTAGGAGA
CCGTGTCACCATCACTTGCCGGGCAAGTCAGAGTATTGGTACTCTTTTAC
GTTGGTATCAGCAGAAACCAGGGAAAGCCCCTAAGCTCCTGATCTATCTT
ACTTCCGTTTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTCAACAGATGGTTTATCGTCCTTATACGTTCGGCCAA
GGGACCAAGGTGGAAATCAAACGG

BMS2h-502 (SEQ ID NO: 1286)
GACATCCAGATGACCCAGTCTCCATCCTCCCTGTCTGCATCTGTAGGAGA
CCGTGTCACCATCACTTGCCGGGCAAGTCAGACTATTGAGACTAATTTAG
AGTGGTACCAGCAGAAACCAGGGAAAGCCCCTAAGCTCCTGATCTATGAT
TCTTCCCAGTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTCAACAGTATGATAAGGTTCCTGCGACGTTCGGCCAA
GGGACCAAGGTGGAAATCAAACGG

BMS2h-503 (SEQ ID NO: 1287)
GACATCCAGATGACCCAGTCTCCATCCTCCCTGTCTGCATCTGTAGGAGA
CCGTGTCACCATCACTTGCCGGGCAAGTCATCATATTCAGAGGTATTTAT
CGTGGTACCAGCAGAAACCAGGGAAAGCCCCTAAGCTCCTGATCCTTTGG
GGTTCCAGTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTGGGCAGTGGTGGGCTCCTCCTCCGACGTTCGGCCAA
GGGACCAAGGTGGAAATCAAACGG

BMS2h-503-1 (SEQ ID NO: 1288)
GACATCCAGATGACCCAGTCTCCATCCTCCCTGTCTGCATCTGTAGGAGA
CCGTGTCACCATCACTTGCCGGGCAAGTCATCATATTCAGAGGTATTAT
CGTGGTACCAGCAGAAACCAGGGAAAGCCCCTAAGCTCCTGATCCTTTGG
GGTTCCAGTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTGGGCAGTGGTGGGCTCCTCCTCAGACGTTCGGCCAA
GGGACCAAGGTGGAAATCAAACGG

BMS2h-503-2 (SEQ ID NO: 1289)
GACATCCAGATGACCCAGTCTCCATCCTCCCTGTCTGCATCTGTAGGAGA
CCGTGTCACCATCACTTGCCGGGCAAGTCATGATATTCAGAGGTATTTAT
CGTGGTACCAGCAGAAACCAGGGAAAGCCCCTAAGCTCCTGATCCTTTGG
GGTTCCCAGTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTGGGCAGTGGTGGGCTCCTCCTCAGACGTTCGGCCAA
GGGACCAAGGTGGAAATCAAACGG

TABLE 4-continued

Human Anti-CD40L VK Domain Encoding Nucleotide Sequences

BMS2h-504 (SEQ ID NO: 1290)
GACATCCAGATGACCCAGTCTCCATCCTCCCTGTCTGCATCTGTAGGAGA
CCGTGTCACCATCACATGCCGGGCAAGTCAGTATATTGATACTAATTTAG
AGTGGTACCAGCAGAAACCAGGGAAAGCCCCTAAGCTCCTGATCTATGAT
GGTTCCTGTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTGGGCAGGGGGCTGTTGTGCCTGTTACGTTCGGCCAA
GGGACCAAGGTGGAAATCAAACGG

BMS2h-508 (SEQ ID NO: 1291)
GACATCCAGATGACCCAGTCTCCATCCTCCCTGTCTGCATCTGTAGGAGA
CCGTGTCACCATCACTTGCCGGGCAAGTCAGGATATTGCTTTTGATTTAG
AGTGGTATCAGCAGAAACCAGGGAAAGCCCCTAAGCTCCTGATCTATTCG
GCGTCCATGTTGCAAAGTGGGGTCCCATCACGTTTCAGTGGCAGTGGATC
TGGGTCAGATTTCACTCTCACCATCAGCAGTCTGCAACCTGAAGATTTTG
CTACGTACTACTGTCAACAGTATAATCTTCAGCCTCCTACGTTCGGCCAA
GGGACCAAGGTGGAAATCAAACGG

BMS2h-509 (SEQ ID NO: 1292)
GACATCCAGATGACCCAGTCTCCATCCTCCCTGTCTGCATCTGTAGGAGA
CCGTGTCACCATCACTTGCCGGGCAAGTCAGAATATTGCTACGCTGTTAC
GTTGGTACCAGCAGAAACCAGGGAAAGCCCCTAAGCTCCTGATCTATGCT
GGTTCCATGTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTCAACAGATGTGGCAGCGTCCTTATACGTTCGGCCAA
GGGACCAAGGTGGAAATCAAACGG

BMS2h-51 (SEQ ID NO: 1293)
GACATCCAGATGACCCAGTCTCCATCCTCCCTGTCTGCATCTGTAGGAGA
CCGTGTCACCATCACTTGCCGGGCAAGTCAGCTATTGTTGATGAGTTAG
ATTGGTACCAGCAGAAACCAGGGAAAGCCCCTAAGCTCCTGATCTATTGCT
GCGTCCATTTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTCATCAGTGGTCTACTTATCCTACGACGTTCGGCCAA
GGGACCAAGGTGGAAATTAAACGG

BMS2h-510 (SEQ ID NO: 1294)
GACATCCAGATGACCCAATCTCCATCCTCCCTGTCTGCATCTGTAGGAGA
CCGTGTCACCATCACTTGCCGGGCAAGTCAGACATTAGCAGCTATTTAA
ATTGGTACCAGCAGAAACCAGGGAAAGCCCCTAAGCTCCTAATCGATGGT
GTTTCCGGTTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTGGGCAGGATTGGGATTGGCCTCGTACGTTCGGCCAA
GGGACCAAGGTGGAAATCAAACGG

BMS2h-511 (SEQ ID NO: 1295)
GACATCCAGATGACCCAGTCTCCATCCTCCCTGTCTGCATCTGTAGGAGA
CCGTGTCACCATCACTTGCCGGGCAAGTAGGAATATTCGTGATTGGTTAC
GGTGGTACCAGCAGAAACCAGGGAAAGCCCCTAAGCTCCTGATCGATTGG
GGGTCCGTGTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTGCTCAGACGTGGGATGATCCTCTGACGTTCGGCCAA
GGGACCAAGGTGGAAATCAAACGG

BMS2h-511-1 (SEQ ID NO: 1296)
GACATCCAGATGACCCAGTCTCCATCCTCCCTGTCTGCATTTGTAGGAGA
CCGTGTCACCATCACTTGCCGGGCAAGTAGGAATATTCGTGATTGGTTAC
GGTGGTACCAACAGAAACCAGGGAAAGCCCCTAAGCTCCTGATCGATTGG
GGGTCCGAGTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTGCTCAGACGTGGTATGATCCTCTGACGTTCGGCCAC
GGGACCAAGGTGGAAATCAAACGG

BMS2h-512 (SEQ ID NO: 1297)
GACATCCAGATGACCCAGTCTCCATCCTCCCTGTCTGCATCTGTAGGAGA
CCGTGTCACCATCACTTGCCGGGCAAGTATTGATATTCATGGTGGTTTAA
CTTGGTACCAGCAGAAACCAGGGAAAGCCCCTAAGCTCCTGATCGTGGGG
GTTTCCGGTTTGCAAAGTGGGGTCCCATCACGTTTCAGTGGCAGTGGATC
TGGGACAGATTTCACTCTCACCATCAGCAATCTGCAACCTGAAGATTTTG
CTACGTACTACTGTGCGCAGGTGTGGCGTAGGCCTTTTACGTTCGGCCAA
GGGACCAAGGTGGAAATCAAACGG

BMS2h-513 (SEQ ID NO: 1298)
GACATCCAGATGACCCAGTCTCCATCCTCCCTGTCTGCATCTGTAGGAGA
CCGTGTCACCATCACTTGCCGGGCAAGTCAGGATATTGGGAGTTCGTTAT
CTTGGTATCAGCAGAAACCAGGGAAAGCCCCTAAGCTCCTGATCTATGCT
TCTTCCCTGTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTCAACAGACTTATGCTCTTCCTGTTACGTTCGGCCAA
GGGACCAAGGTGGAAATCAAACGG

BMS2h-514 (SEQ ID NO: 1299)
GACATCCAGATGACCCAGTCTCCATCCTCCCTGTCTGCATCTGTAGGAGA
CCGTGTCACCATCACTTGCCGGGCAAGTCAGCAGATTGAGACGAATTTAG
AGTGGTATCAGCAGAAACCAGGGAAAGCCCCTAAGCTCCTGATCTATGAT
GGTTCCTGGTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTCAACAGTATAAGTATCTGCCTGTGACGTTCGGCCAA
GGGACCAAGGTGGAAATCAAACGG

BMS2h-52 (SEQ ID NO: 1300)
GACATCCAGATGACCCAGTCTCCATCCTCCCTGTCTGCATCTGTAGGTGA
CCGTGTCACCATCACTTGCCGGGCAAGTCAGGATATTGGGTCTGCGTTAA
GGTGGTATCAGCAGAAACCAGGGAAAGCCCCTAAGCTCCTGATCTATTTG
GGTTCCGATTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTCAACAGACGCAGTATTTTCCTACGACGTTCGGCCAA
GGGACCAAGGTGGAAATCAAACGG

BMS2h-53 (SEQ ID NO: 1301)
GACATCCAGATGACCCAGTCTCCATCCTCCCTGTCTGCATCTGTAGGAGA
CCGTGTCACCATCACTTGCCGGGCAAGTCAGGCGATTTATGGGGGGTTAC
GGTGGTACCAGCAGAAAACCAGGGAAAGCCCCTAAGCTCCTGATCTATGGG
GAGTCCATGTTGCAAAGTGGGGTCCCATCACGTTTCAGTGGCAGTGGATC
TGGGACAGATTTCACTCTCACCATCAGCAGTCTGCATCTGAAGATTTTG
CTACGTACTACTGTCAACAGGTTTATCATAAGCCTTTTACGTTCGGCCAA
GGGACCAAGGTGGAAATCAAACGG

BMS2h-536 (SEQ ID NO: 1302)
GACATCCAGATGACCCAGTCTCCATCCTCCCTGTCTGCATCTGTAGGAGA
CCGTGTCACCATCACGTGCCGGGCAAGTCAGCGTATTGGGGTGTGGTTAG
ATTGGTACCAGCAGAAACCAGGGAAAGCCCCTAAGCTCCTGATCTATGAT
GGTTCCTTTTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTCAACAGACTTTTTCGAGTCCTTCTACGTTCGGCCAA
GGGACCAAGGTGGAAATCAAACGG

BMS2h-537 (SEQ ID NO: 1303)
GACATCCAGATGACCCAGTCTCCATCCTCCCTGTCTGCATCTGTAGGAGA
CCGTGTCCCCATCACTTGCCGGGCAAGTCAGTGGATTGGGGATGAGTTAT
ATTGGTATCAGCAGAAACCAGGGAAAGCCCCTAAGCTCCTGATCTATAGT
TCTTCCACTTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTCAACAGTCGTTTCAGTTTCCTTATACGTTCGGCCAA
GGGACCAAGGTGGAAATCAAACGG

BMS2h-538 (SEQ ID NO: 1304)
GACATCCAGATGACCCAGTCTCCATCCTCCCTGTCTGCATCTGTAGGAGA
CCGTGTCACCATCACTTGCCGGGCAAGTAGTAATATTACGGGGCCGTTAG
AGTGGTACCAGCAGAAACCAGGGAAAGCCCCTAAGCTCCTGATCCCTGGT
TGGTCCACTTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTGGTCAGGTGTGGGGGGAGCCTGTTACGTTCGGCCAA
GGGACCAAGGTGGAAATCAAACGG

BMS2h-539 (SEQ ID NO: 1305)
GACATCCAGATGACCCAGTCTCCATCCTCCCTGTCTGCGTCTATAGGAGA
CCGTGTCACCATCACTTGCCGGGCAAGTCAGCGTATTGCTTATGGTTTAC
ATTGGTACCAGCAGAAACCAGGGAAAGCCCCTAAGCTCCTGATCGGGGGG
CGGTCCGGTTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTGTGCAGCCTGGGATGCCGCCTGATACGTTCGGCCAA
GGGACCAAGGTGGAAATCAAACGG

BMS2h-540 (SEQ ID NO: 1306)
GACATCCAGATGACCCAGTCTCCATCCTCCCTGTCTGCATCTGTAGGAGA
CCGTGTCACCATCACTTGCCGGGCAAGTAAGCAGATTGTTGGTGGTTTAT
CTTGGTACCAGCAGAAACCAGGGAAAGCCCCTAAGCTCCTGATCGGGCGT
CATTCTGGGTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTGTGCAGGGGTTTGGGCTCCTGGGACGTTCGGCCAA
GGGACCAAGGTGGAAATCAAACGG

TABLE 4-continued

Human Anti-CD40L VK Domain Encoding Nucleotide Sequences

BMS2h-541 (SEQ ID NO: 1307)
GACATCCAGATGACCCAGTCTCCATCCTCCCTGTCTGCATCTGTAGGAGA
CCGTGTCACCATCACTTGCCGGGCAAGTCCTGCTATTGCTGCTAAGTTAG
ATTGGTACCAGCAGAAACCAGGGAAAGCCCCTAAGCTCCTGATCGGTCGG
GATTCCGGGTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTGGTCAGCTGTGGGCGGGGCCTCCGACGTTCGGCCAA
GGGACCAAGGTGGAAATCAAACGG

BMS2h-542 (SEQ ID NO: 1308)
GACATCCAGATGACCCAGTCTCCATCCTCCCTGTCTGCATCTGTAGGAGA
CCGTGTCACCATCACTTGCCGGGCAAGTCGTACTATTGCTGATGGGTTAG
ATTGGTACCAGCAGAAACCAGGGAAAGCCCCTAAGCTCCTGATCGGGGCG
TATTCCGGTTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTGGTCAGCTTTGGGAGGGTCCTCCGACGTTCGGCCAA
GGGACCAAGGTGGAAATCAAACGG

BMS2h-543 (SEQ ID NO: 1309)
GACATCCAGATGACCCAGTCTCCATCCTCCCTGTCTGCATCTGTAGGAGA
CCGTGTCACCATCACTTGCCGGGCAAGTCAGAGGATTTATGGTTTTAG
ATTGGTATCAGCAGAAACCAGGGAAAGCCCCTAAGCTCCTGATCTATGGG
GTGTCCTCGTTGCAAAGTGGGGTCCCATCACGTTTTAGTGGCAGCGGATC
TGGGACAGATTTCACTCTCACCATCAGCAGTCTGCAACCTGAAGATTTTG
CTACGTACTACTGTCAACAGACTTTGGCGTGGCCTTTTACGTTCGGCCAA
GGGACCAAGGTGGAAATCAAACGG

BMS2h-544 (SEQ ID NO: 1310)
GACATCCAGATGACCCAGTCTCCATCCTCCCTGTCTGCATCTGTAGGAGA
CCGTGTCACCATCACTTGCCGGGCAAGTCAGGATATTCGGGATTGGTTAA
TGTGGTACCAGCAGAAACCAGGGAAAGCCCCTAAGCTCCTGATCTATTGG
GGTTCCTTTTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTCAACAGCTGTATGATACTCCTTATACGTTCGGCCAA
GGGACCAAGGTGGAAATCAAACGG

BMS2h-545 (SEQ ID NO: 1311)
GACATCCAGATGACCCAGTCTCCATCCTCCCTGTCTGCATCTGTAGGAGA
CCGTGTCACCATCACTTGCCGGGCAAGTCAGAATATTAATACGGGTTTAG
ATTGGTATCAGCAGAAACCAGGGAAAGCCCCTAAGCTCCTGATCTATGAT
AGTTCCGCTTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTCAACAGACGTCGTATTATCCTTATACGTTCGGCCAA
GGGACCAAGGTGGAAATCAAACGG

BMS2h-546 (SEQ ID NO: 1312)
GACATCCAGATGACCCAGTCTCCATCCTCCCTGTCTGCATCTGTAGGAGA
CCGTGTCACCATCACTTGCCGGGCAAGTCAGAAGATTTTGGTTGGTTAG
ATTGGTACCAGCAGAAACCAGGGAAAGCCCCTAAGCTCCTGATCTATGGG
ACTTCCAAGTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTCAACAGGTTTATTGCTTCCTTATACGTTCGGCCAA
GGGACCAAGGTGGAAATCAAACGG

BMS2h-547 (SEQ ID NO: 1313)
GACATCCAGATGACCCAGTCTCCATCCTCCCTGTCTGCATCTGTAGGAGA
CCGTGTCACCATCACTTGCCGGGCAAGTTCGAATATTGGGGCGGATTTAG
ATTGGTACCAGCAGAAACCAGGGAAAGCCCCTAAGCTCCTGATCGGGGGG
GCGTCCGGTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTGGGCAGCTGTGGAATGGGCCTCCTACGTTCGGCCAA
GGGACCAAGGTGGAAATCAAACGG

BMS2h-548 (SEQ ID NO: 1314)
GACATCCAGATGACCCAGTCTCCATCCTCCCTGTCTGCATCTGTAGGAGA
CCGTGTCACCATCACTTGCCGGGCAAGTAGTCCGATTTATGATGGTTTAG
ATTGGTACCAGCAGAAACCAGGGAAAGCCCCTAAGCTCCTGATCTCTGGT
GCTTCCTGGTTGCAAAGTGGGGTCCCATCACGCTTCAGTGGCAGTGGATC
TGGGACAGATTTCACTCTCACCATCAGCAGTCTGCAACCTGAAGATTTTG
CTACGTACTACTGTGGTCAGTTGTGGTTGGGTCCTCCGACGTTCGGCCAA
GGGACCAAGGTGGAAATCAAACAG

BMS2h-549 (SEQ ID NO: 1315)
GACATCCAGATGACCCAGTCTCCATCCTCCCTGTCTGCATCTGTAGGAGA
CCGTGTCACCATCACTTGCCGGGCAAGTTCGCGTATTTATAATGGTTAC
ATTGGTACCAGCAGAAACCAGGGAAAGCCCCTAAGCTCCTGATCGGTGGT
CGGTCCGGGTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTGCTCAGGTGGGGAGGCTCCTTCTACGTTCGGCCAA
GGGACCAAGGTGGAAATCAAACGG

BMS2h-550 (SEQ ID NO: 1316)
GACATCCAGATGACCCAGTCTCCATCCTCCCTGTCTGCATCTGTAGGAGA
CCGTGTCACCATCACTTGCCGGGCAAGTAGGTTTATTAATGAGGAGTTAG
ATTGGTACCAGCAGAAACCAGGGAAAGCCCCTAAGCTCCTGATCTCGTGG
TCTTCCTGGTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTGTGCAGCCGGGGGGTGGTCCTGGGACGTTCGGCCAA
GGGACCAAGGTGGAAATCAAACGG

BMS2h-551 (SEQ ID NO: 1317)
GACATCCAGATGACCCAGTCTCCATCCTCCCTGTCTGCATCTGTAGGAGA
CCGTGTCACCATCACTTGCCGGGCAAGTAGGGATATTCTGGATGAGTTAG
ATTGGTACCAGCAGAAACCAGGGAAAGCCCCTAGGCTCCTGATCGGTGGG
GGGTCCGGGTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTGGTCAGCTGTGGCATGGGCCTCCGACGTTCGGCCAA
GGGACCAAGGTGGAAATCAAACGG

BMS2h-552 (SEQ ID NO: 1318)
GACATCCAGATGACCCAGTCTCCATCCTCCCTGTCTGCATCTGTAGGAGA
CCGTGTCACCATCACTTGCCGGGCAAGTAGTAGTCTATTTATACGGGTTTAC
ATTGGTACCAGCAGAAACCAGGGAAAGCCCCTAAGCTCCTGATCGGTGGG
CGGTCCGGGTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTATGCAGGTTGGGACGGCTCCTGCTACGTTCGGCCAA
GGGACCAAGGTGGAAATCAAACGG

BMS2h-585 (SEQ ID NO: 1319)
GACATCCGGATGACCCAGTCTCCATCCTCCCTGTCTGCATCTGTAGGAGA
CCGTGTCACCATCACTTGCCGGGCAAGTCAGAATATTTCTAGGCGGTTAC
TGTGGTACCAGCAGAAACCAGGGAAAGCCCCTAAGCTCCTGATCTATTCT
TCTTCCCGGTTGCAAAGTGGGGTCCCATCACGTTTCGGTGGCAGTGGATC
TGGGACGGATTTCACTCTCACCATCAGCAGTCTGCAACCTGAAGATTTTG
CTACGTACTACTGTCAACAGACGTATAGCTATCCTCATACGTTCGGCCAA
GGGACCAAGGTGGAAATCAAACGG

BMS2h-604 (SEQ ID NO: 1320)
GACATCCAGATGACCCAGTCTCCATCCTCCCTGTCTGCATCTGTAGGAGA
CCGTGTCACCATCACTTGCCGGGCAAGTAGTCCGATTCCGCAGGATTTAT
ATTGGTACCAGCAGAAACCAGGGAAAGCCCCTAAGCTCCTGATCGTTGGG
ATTTCCCAGTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTGGGCAGTTGTGGAGTGCGCCTGCTACGTTCGGCCAA
GGGACCAAGGTGGAAATCAAACGG

BMS2h-605 (SEQ ID NO: 1321)
GACATCCAGATGACCCAGTCTCCATCCTCCCTGTCTGCATCTGTAGGAGA
CCGTGTCACCATCACTTGCCGGGCAAGTAAGTCTATTGATGGGATGTTAG
ATTGGTACCAGCAGAAACCAGGGAAAGCCCCTAAGCTCCTGATCCCTGGT
TTTTCCGGTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTGGGCAGTCGGTTGAGGCGCCTTGGACGTTCGGCCAA
GGGACCAAGGTGGAAATCAAACGG

BMS2h-606 (SEQ ID NO: 1322)
GACATCCAGATGACCCAGTCTCCATCCTCCCTGTCTGCATCTGTAGGAGA
CCGTGTCACCATCACTTGCCGGGCAAGTCGGTATATTGCTCATCCTTTAG
ATTGGTACCAGCAGAAACCAGGGAAAGCCCCTAAGCTCCTGATCCCGGGT
TCGTCCGTTTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTGGTCAGTCGGTTGTGGTGCCTTGGACGTTCGGCCAA
GGGACCAAGGTGGAAATCAAACGG

BMS2h-607 (SEQ ID NO: 1323)
GACATCCAGATGACCCAGTCTCCATCCTCCCTGTCTGCATCTGTAGGAGA
CCGTGTCACCATCACTTGCCGGGCAAGTCGGACGATTGAGGGTGGTTTAG
ATTGGTACCAGCAGAAACCAGGGAAAGCCCCTAAGCTCCTGATCATGGGG
GGTTCCGGTTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTGGGCAGTTGTGGGTGGGTCCTCCTACGTTCGGCCAA
GGGACCAAGGTGGAAATCAAACGG

TABLE 4-continued

Human Anti-CD40L VK Domain Encoding Nucleotide Sequences

BMS2h-608 (SEQ ID NO: 1324)
GACATCCAGATGACCCAGTCTCCATCCTCCCTGTCTGCATCTGTAGGAGA
CCGTGTCACCATCACTTGCCGGGCAAGTAAGTTTATTAGGGATGAGTTAT
ATTGGTACCAGCAGAAACCAGGGAAAGCCCCTAGGCTCCTGATCGGTGGT
TCGTCCTTGTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTGGGCAGCTGTGGCGGGCGCCTGCGACGTTCGGCCAA
GGGACCAAGGTGGAAATCAAACGG

BMS2h-609 (SEQ ID NO: 1325)
GACATCCAGATGACCCAGTCTCCATCCTCCCTGTCTGCATCTGTAGGAGA
CCGTGTCACCATCACTTGCCGGGCAAGTAAGCCGATTTATGGTGGTTTAG
AGTGGTACCAGCAGAAACCAGGGAAAGCCCCTAGGCTCCTGATCGGGGGG
GGTTCCGTGTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTGGGCAGGTGTGGGGGGGTCCTGTTACGTTCGGCCAA
GGGACCAAGGTGGAAATCAAACGG

BMS2h-610 (SEQ ID NO: 1326)
GACATCCGGATGACCCAGTCTCCATCCTCCCTGTCTGCATCTGTAGGAGA
CCGTGTCACCATCACTTGCCGGGCAAGTCGGCCGATTAGTGGTTGTTTAG
ATTGGTACCAGCAGAAACCAGGGAAAGCCCCTAAGCTCCTGATCGATGGG
GCTTCCGGGTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTGGGCAGTGGTGGGAGTATCCTCCTACGTTCGGCCAA
GGGACCAAGGTGGAAATCAAACGG

BMS2h-611 (SEQ ID NO: 1327)
GACATCCAGATGACCCAGTCTCCATCCTCCCTGTCTGCATCTGTAGGAGA
CCGTGTCACCATCACTTGCCGGGCAAGTAAGCTATTGTGAGGGATTTAG
AGTGGTACCAGCAGAAACCAGGGAAAGCCCCTAAGCTCCTGATCCATGGT
GTGTCCACGTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTGGGCAGCTTGAGGCGGCGCCTGCGACGTTCGGCCAA
GGGACCAAGGTGGAAATCAAACGG

BMS2h-612 (SEQ ID NO: 1328)
GACATCCAGATGACCCAGTCTCCATCCTCCCTGTCTGCATCTGTAGGAGA
CCGTGTCACCATCACTTGCCGGGCAAGTCGGGATATTGGTGATTTTAT
ATTGGTACCAGCAGAAACCAGGGAAAGCCCCTAGGCTCCTGATCGTTTGG
GCGTCCGTGTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTGCGCAGTGGGGGACTCCTCCTACGACGTTCGGCCAA
GGGACCAAGGTGGAAATCAAACGG

BMS2h-613 (SEQ ID NO: 1329)
GACATCCAGATGACCCAGTCTCCATCCTCCCTGTCTGCATCTGTAGGAGA
CCGTGTCACCATCACTTGCCGGGCAAGTAATCGTATTGAGTATGGTTAG
ATTGGTACCAGCAGAAACCAGGGAAAGCCCCTAAGCTCCTGATCTCGGGG
TCTTCCCGTTTGCAAAGTGGGGTCCCATCACGTTTCAGTAGCAGTGGATC
TGGGACAGATTTCACTCTCACCATCAGCAGTCTGCAACCTGAAGATTTTG
CTACGTACTACTGTGGGCAGCTTGAGGCGGCGCCTGCGACGTTCGGCCAA
GGGACCAAGGTGGAAATCAAACGG

BMS2h-614 (SEQ ID NO: 1330)
GACATCCAGATGACCCAGTCTCCATCCTCCCTGTCTGCATCTGTAGGAGA
CCGTGTCACCATCACTTGCCGGGCAAGTCGGAATATTGGGCATTTTTAG
ATTGGTACCAGCAGAAACCAGGGAAAGCCCCTAAGCTCCTGATCTTGGGG
GGGTCCTCGTTGCAAAGTGGGGTCCCATCACGTTTCAGTGGCAGCGGGTC
TGGGACAGATTTCACTCTCACCATCAGCAGTCTGCAACCTGAAGATTTTG
CTACGTACTACTGTGGGCAGTTGGTGGAGCCTCCTGCGACGTTCGGCCAA
GGGACCAAGGTGGAAATCAAACGG

BMS2h-615 (SEQ ID NO: 1331)
GACATCCAGATGACCCAGTCTCCATCCTCCCTGTCTGCATCTGTAGGAGA
CCGTGTCACCATCACTTGCCGGGCAAGTTCGAGTATTTATAGTGATTTAT
ATTGGTACCAGCAGAAACCAGGGAAAGCCCCTAAGCTCCTGATCGATGGG
TGGTCCGGGTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTGGGCAGCTGCATCGTGCTCCTGCGACGTTCGGCCAA
GGGACCAAGGTGGAAATCAAACGG

BMS2h-616 (SEQ ID NO: 1332)
GACATCCAGATGACCCAGTCTCCATCCTCCCTGTCTGCATCTGTAGGAGA
CCGTGTCACCATCACTTGCCGGGCAAGTAGGTTTATTACTGATCGTTTAG
ATTGGTACCAGCAGAAACCAGGGAAAGCCCCTAAGCTCCTGATCGGTGGT
GTTTCCGGGTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTGGGCAGAGTTCGGAGTTGCCTTGGACGTTCGGCCAA
GGGACCAAGGTGGAAATCAAACGG

BMS2h-617 (SEQ ID NO: 1333)
GACATCCAGATGACCCAGTCTCCATCCTCCCTGTCTGCATCTGTAGGAGA
CCGTGTCACCATCACTTGCCGGGCAAGTCGTAAGATTGGTAGTGAGTTAT
ATTGGTACCAGCAGAAACCAGGGAAAGCCCCTAAGCTCCTGATCGGTGGT
AGGTCCCGGTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTGGGCAGTTGTGGGAGCCTCCTGCGACGTTCGGCCAA
GGGACCAAGGTGGAAATCAAACGG

BMS2h-618 (SEQ ID NO: 1334)
GACATCCAGATGACCCAGTCTCCATCCTCCCTGTCTGCATCTGTAGGAGA
CCGTGTCACCATCACTTGCCGGGCAAGTAGGAATATTGGTAATGGTTTAG
ATTGGTACCAGCAGAAACCAGGGAAAGCCCCTAAGCTCCTGATCGGGGAG
GGGTCCCGTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTGGGCAGCTTTGGCATACTCCTACGTTCGGCCAA
GGGACCAAGGTGGAAATCAAACGG

BMS2h-619 (SEQ ID NO: 1335)
GACATCCAGATGACCCAGTCTCCATCCTCCCTGTCTGCATCTGTAGGAGA
CCGTGTCACCATCACTTGCCGGGCAAGTCGGAATATTTATGGTTGGTTAT
CGTGGTACCAGCAGAAACCAGGGAAAGCCCCTAGGCTCCTGATCGGTGGG
TGGTCCGGTTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTGCGCAGGATTATACGTTGCCTGGTACGTTCGGCCAA
GGGACCAAGGTGGAAATCAAACGG

BMS2h-730 (SEQ ID NO: 1336)
GACATCCAGATGACCCAGTCTCCATCCTCCCTGTCTGCATCTGTAGGAGA
CCGTGTCACCATCACTTGCCGGGCAAGTCAGGATATTAAGGATTGGTTAC
ATTGGTACCAGCAGAAACCAGGGAAAGCCCCTAAGCTCCTGATCTATTTT
GCGTCCGGTTTGCAAAGTGGGGTCCCATCACGTTTCAGTGGCAGTGGATC
TGGGACAGATTTCACTCTCACCATCAGCAGTCTGCAACCTGAAGATTCTG
CTACGTACTACTGTCAACAGCATTATAGTACGCCTTATACGTCCGGCCAA
GGGACCAAGGTGGAAATCAAACGG

BMS2h-731 (SEQ ID NO: 1337)
GACATCCAGATGACCCAGTCTCCACCCTCCCTGTCTGCATCTGTAGGAGA
CCGTGTCACCATCACTTGCCGGGCAAGTCAGTTGATTTCTTCATTTAG
ATTGGTACCAGCAGAAACCAGGGAAAGCCCCTAAGCTCCTGGTCTATGAT
GCTTCCGAGTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTCAACAGCATCGCAGTCTGCCTTTTACGTTCGGCCAA
GGGACCAAGGTAGAAATCAAACGG

BMS2h-732 (SEQ ID NO: 1338)
GACATCCAGATGACCCAGTCTCCATCCTCCCTGTCTGCATCTGTAGGAGA
CCGTGTCACCATCACTTGCCGGGCAAGTCAGTGGATTGGTGGGGCGTTAG
CGTGGTACCAGCAGAAACCAGGGAAAGCCCCTAGGCTCCTTATCTATCAG
ATTTCCGTTTTGCAAAGTGGGGATCCCATCACGTTTCAGTGGCAGTGGATC
TGGGACAGATTTCACTCTCACCATCAGCAGTCTGCAACCTGAAGATTTTG
CTACGTACTACTGTCAACAGTATATTCGGTCTCCTTTTACGTTCGGCCAA
GGGACCAAGGTGGAAATCAAACGG

BMS2h-733 (SEQ ID NO: 1339)
GACATCCAGATGACCCAGTCTCCATCCTCCCTGTCTGCATCTGTAGGAGA
CCGTGTCACCATCACTTGCCGGGCAAGTCAGAGTATTGGGGCGGCGTTAA
ATTGGTATCAGCAGAAACCAGGGAAAGCCCCTAAGCTCCTGATCTATGGT
CTGTCCTCTTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTCAACAGCTGTTTAGGCTTCCTTTTGACGTTCGGCCAA
GGGACCAAGGTGGAAATCAAACGG

BMS2h-734 (SEQ ID NO: 1340)
GACATCCAGATGACCCAGTCTCCATCCTCCCTGTCTGCATCTGTAGGAGA
CCGTGTCACCATCACTTGCCGGGCAAGTCAGCCTATTGGGGGTCGTTTAG
TGTGGTACCAGCAGAAACCAGGGAAAGCCCCTAAGCTCCTGATCTATGGG
TCTTCCATTTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTCAACAGTATGCTGAGGCTCCTATTACGTTCGGCCAA
GGGACCAAGGTGGAAATCAAACGG

TABLE 4-continued

Human Anti-CD40L VK Domain Encoding Nucleotide Sequences

BMS2h-735 (SEQ ID NO: 1341)
GACATCCAGATGACCCAGTCTCCATCCTCCCTGTCTGCATCTGTAGGAGA
CCGTGTCACCATCACTTGCCGGGCAAGTCAGAATATTGGGTCTAGTTTAA
TTTGGTACCAGCAGAAACCAGGGAAAGCCCCTACGCTCCTGATCTATTAT
TCGTCCAAGTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTCAACAGTCTTTGTCGAGTCCTTATACGGTCGGCCAA
GGGACCAAGGTGGAAATCAAACGG

BMS2h-736 (SEQ ID NO: 1342)
GACATCCAGATGACCCAGTCTCCATCCTCCCTGTCTGCATCTGTAGGAGA
CCGTGTCACCATCACTTGCCGGGCAAGTCAGTGGATTGGGAGTGAGTTAG
CGTGGTATCAGCAGAAACCAGGGAAAGCCCCTAAGCTCCTGATCTATTGG
ACGTCCAATTTGCAAAGTGGGGTCCCATCACGTTTCAGTGGCAGTGGATC
TGGGACAGATTTCACTCTCACCATCAGCAATCTGCAACCTGAAGATTTTG
CTACGTACTACTGTCAACAGATTCTGGAGACTCCTTTGACGTTTGGCCAA
GGGACCAAGGTGGAAATCAAACGG

BMS2h-737 (SEQ ID NO: 1343)
GACATCCAGATGACCCAGTCTCCATCCTCCCTGTCTGCATCTGTAGGAGA
CCGTGTCACCATCACTTGCCGGGCAAGTCAGAAGATTTGGGATGCTTTAT
ATTGGTACCAGCAGAAACCAGGGAAAGCCCCTAAGCTCCTGATCTATCGT
GGGTCCATTTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTCAACAGTTTTATCGGTGGCCTCATACGTTCGGCCAA
GGGACCAAGGTGGAAATCAAACGG

BMS2h-738 (SEQ ID NO: 1344)
GACATCCAGATGACCCAGTCTCCATCCTCCCTGTCTGCATCTGTAGGAGA
CCGTGTCACCATCACTTGCCGGGCAAGTCAGCATATTGAGGATTCTTTAC
GGTGGTACCAGCAGAAACCAGGGAAAGCCCCTAAGCTCCTGATCTATTAT
GGTTCCGTGTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTCAACAGATGTATAAGTTTCCTATTACGTTCGGCCAA
GGGACCAAGGTGGAAATCAAACGG

BMS2h-739 (SEQ ID NO: 1345)
GACATCCAGACGACCCAGTCTCCATCCTCCCTGTCTGCATCTGTAGGAGA
CCGTGTCACCATCACTTGCCGGGCAAGTCAGCGGATTAATTCTTCTTTAC
TGTGGTACCAGCAGAAACCAGGGAAAGCCCCTAAGCTCCTGATCTATGAT
ACTTCCACTTTGCAAAGTGGGGTCCCATCACGTTTCAGTGGCAGTAGATC
TGGGACAGATTTCACTCTCACCATCAGCAGTCTGCAACCTGAAGATTTCG
CTACGTACTACTGTCAACAGATTTGGGGTTCGCCTCCTACGTTCGGCCAG
GGGACCAAGGTGGAAATCAAACGG

BMS2h-740 (SEQ ID NO: 1346)
GACATCCAGATGACCCAGTCTCCATCCTCCCTGTCTGCATCTGTAGGAGA
CCGTGTCACCATCACTTGCCGGGCAAGTCAGTCGATTCCTGTTGGTTTAA
ATTGGTACCAGCAGAAACCAGGGAAAGCCCCTAGGCTCCTGATCTATTCT
GGGTCCACTTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTCAACAGGATTGGTATTATCCTAATACGTTCGGCCAA
GGGACCAAGGTGGAAATCAAACGG

BMS2h-785 (SEQ ID NO: 1347)
GACATCCAGATGACCCAGTCTCCATCCTCCCTGTCTGCATCTGTAGGAGA
CCGTGTCACCATCACTTGCCGGGCAAGTCAGCCTATTTATGGTTGGTTAA
ATTGGTATCAGCAGAAACCAGGGAAAGCCCCTAAGCTCCTGATCTATTTG
ACGTCCGGGTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTCAACAGATTCATAGTTCTCCTTTTACGTTCGGCCAA
GGGACCAAGGTGGAAATCAAACGG

BMS2h-8 (SEQ ID NO: 1348)
GACATCCAGATGACCCAGTCTCCATCCTCCCTGTCTGCATCTGTAGGAGA
CCGTGTCACCATCACTTGCCGGGCAAGTCAGTTTATTGATACGTCGTTAG
AGTGGTATCAGCAGAAACCAGGGAAAGCCCCTAAGCTCCTGATCTATGAT
GGGTCCCATTTGCAAAGTGGGGTCCCATCACGTTTCAGTGGCAGTGGATC
TGGGACAGATTTCACTCTCACCATCAGCAGTCTGCAACCTGAAGATTTAG
CTACGTACTACTGTCAACAGTATTGGGTTCTTCCTCTGACGTTCGGCCAA
GGGACCAAGGTGGAAATCAAACGG

BMS2h-86 (SEQ ID NO: 1349)
GACATCCAGATGACCCAGTCTCCATCCTCCCTGTCTGCATCTGTAGGAGA
CCGTGTCACCATCACTTGCCGGGCAAGTCAGGATATTGGGGATGCTTTAT
TTTGGTACCAGCAGAAACCAGGGAAAGCCCCTAAGCTCCTGATCTATTAT
TCTTCCATGTTGCAAAGTGGGGTCCCATCACGTTTCAGTGGCGGTGGATC
TGGGACAGATTTCACTCTCACCATCAGCAGTCTGCAACCTGAAGATTTTG
CTACGTACTACTGTCAACAGCGGCATAGTACTCCTGCTACGTTCGGCCAA
GGGACCAAGGTGGAAATCAAACGG

BMS2h-87 (SEQ ID NO: 1350)
GACATCCAGATGACCCAGTCTCCATCCTCCCTGTCTGCATCTGTAGGAGA
CCGTGTCACCATCACTTGCCGGGCAAGTCAGGATATTGATGAGTCTTTAA
TGTGGTACCAGCAGAAACCAGGGAAAGCCCCTAGGCTCCTGATCTATGGG
GTGTCCTATTTGCAAAGTGGGGTCCCATCACGTTTCAGTGGCAGTGGATC
TGGGACAGATTTCACTCTCACCATCAGCAGTCTGCAACCTGAAGATTTCG
CTACGTACTACTGTCAACAGCGGTGGAAGGCTCCTTTTACGTTCGGCCAA
GGGACCAAGGTGGAAATCAAACGG

BMS2h-88 (SEQ ID NO: 1351)
GACATCCAGATGACCCAGTCTCCATCCTCCCTGTCTGCATCTGTAGGAGA
CCGTGTTACCATCACTTGCCGGGCAAGTCAGGAGATTGTGGAGGATTTAT
ATTGGTATCAGCAGAAACCAGGGAAAGCCGCTAAGCTCCTGATCTATGGT
GCGTCCTGGTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTCAACAGACGCGTAGGCGTCCTTATACGTTCGGCCAA
GGGACCAAGGTGGAAATCAAACGG

BMS2h-89 (SEQ ID NO: 1352)
GACATCCAGATGACCCAGTCTCCAGCCTCCCTGTCTGCATCTGTAGGAGA
CCGTGTCACCATCACTTGCCGGGCAAGTCAGGATATTGATCCTATGTTAA
GGTGGTACCAGCAGAAACCAGGGAAAGCCCCTAAGCTCCTGATCTATGCG
GGTTCCATTTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTCAACAGACGCTGGTGACTCCTTATACGTTCGGCCAA
GGGACCAAGGTGGAAATCAAACGG

BMS2h-90 (SEQ ID NO: 1353)
GACATCCAGATGACCCAGTCTCCATCCTCCCTGTCTGCATCTGTAGGAGA
CCGTGTCACCATCACTTGCCGGGCAAGTCGATTTCGGATGCGTTAT
TTTGGTACCAGCAGAAACCAGGGAAAGCCCCTAGGCTCCTGATCTATTAT
GGTTCCGTTTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTCAACAGCGTTTTCAGGAGCCTGTGACGTTCGGCCAA
GGGACCAAGGTGGAAATCAAACGG

BMS2h-91 (SEQ ID NO: 1354)
GACATCCAGATGACCCAGTCTCCATCCTCCCTGTCCGCATCTGTAGGAGA
CCGTGTCACCATCACTTGCCGGGCAAGTCAGCAGATTAGTGATGAGTTAA
ATTGGTATCAGCAGAAACCAGGGAAAGCCCCTAAGCTCCTGATCTATGCT
GTGTCCATTTTGCAAAGTGGGGTCCCATCACGTTTCAGTGGCAGTGGATC
TGGGACAGATTTCACTCTCACCATCAGCAGTCTGCAACCTGAAGATTTTG
CTACGTACTACTGTCAACAGTGGTTGAGTTTTCCTTCGACGTTTGGCCAA
GGGACCAAGGTGGAAATCAAACGG

Example 1

Generation of Human Anti-CD40L Variable Domains BMS2h-2 Through BMS2h-785

The following example describes the generation of the 2 h lineage of anti-human CD40L variable domains, designated BMS2h-2 through BMS2h-785. Following recombinant expression of a repertoire of single immunoglobulin variable domains on the surface of phage, selection is performed by contacting the phage repertoire with immobilized target antigen, washing to remove unbound phage, and propagating the bound phage. This process is frequently referred to as "panning." It is applicable to the screening of single immunoglobulin variable domains, as well as other antibody fragments that can be expressed on a display library, e.g., scFv, Fab, and Fab'. Alternatively, phage may be pre-selected for the expression of properly folded member variants by panning against an immobilized generic ligand (e.g., protein A or protein L) that is only bound by folded members. This has the advantage of reducing the proportion of non-functional members, thereby increasing the proportion of members likely to bind a target antigen. Pre-selection with generic ligands is taught in WO 99/20749, for example. The screening of phage antibody libraries is generally described, for example, by Harrison et al., Meth. Enzymol. 267: 83-109 (1996).

Screening is commonly performed using purified antigen immobilized on a solid support, for example, plastic tubes or wells, or on a chromatography matrix, for example Sepharose™ (Pharmacia). Screening or selection can also be performed on complex antigens, such as the surface of cells (Marks et al., BioTechnology 11: 1145 (1993); de Kruif et al., Proc. Natl. Acad. Sci. USA 92: 3938 (1995)). Another alternative involves selection by binding biotinylated antigen in solution, followed by capture on streptavidin-coated beads. dAb Selection for Clone BMS2h-719 and BMS2h-7xx Series:

Three rounds of selection using decreasing concentrations of antigen (500 nM at round 1; 50 nM at round 2; 50 nM or 5 nM at round 3 depending on the library output used) were performed in parallel against biotinylated (1.2 moles biotin/mole CD40L) human CD40L monomer triple mutant (T211E, S222Y, H224K, [108-261] Construct #7) provided by Bristol-Myers Squibb. Phage from the naïve 4G and 6G Domantis dAb libraries were combined into the pools a) to g) indicated below before initiating selections:
 a) 4G $V_H$ CDR3 lengths between 7-10 amino acids.
 b) 4G $V_H$ CDR3 lengths between 11-15 amino acids.
 c) 4G $V_H$ CDR3 lengths between 7-15 amino acids.
 d) 4G VK
 e) 6G $V_H$ CDR3 lengths between 7-9
 f) 6G $V_H$ CDR3 lengths between 10-15
 g) 6G VK Each round of selection involved adding the desired concentration of biotinylated CD40L to a mixture of 200 µl of phage (from one of the naïve library pools indicated above, or subsequent selection output phage) and 1000 µl of 2% MPBS (Phosphate Buffered Saline) containing 2% (w/v) Marvel [Premier Foods, UK]) and incubating at room temperature for 1 hour by mixing end-over-end. The biotinylated antigen phage complex was then captured by adding 100 µl of resuspended Dynabeads M-280 Streptavidin [Invitrogen, UK] and incubated for 5 minutes with mixing end-over-end at room temperature. The Dynabeads were then recovered using a KingFisher magnetic separator [Thermo Fisher Scientific, UK] and washed 7×1 ml PBST (PBS containing 0.1% (v/v) polyoxyethylenesorbitan 20 monolaurate [Sigma-Aldrich, UK]) followed by 1×1 ml PBS. Bound phage retained on the washed Dynabeads were eluted by incubation with 500 µl of trypsin-PBS (50 µl of 10 mg/ml trypsin [Sigma-Aldrich, UK] dissolved in 50 mM Tris-HCl pH 7.4, 1 mM $CaCl_2$ added to 450 µl PBS). The phage-containing solution was recovered and 250 µl used to infect 1.75 ml of logarithmic growth phase E. coli TG1 (at an ($OD_{600}$ of 0.4) for 30 minutes at 37° C. The E. coli TG1 phage infected culture was centrifuged at 11,600 g in a micro centrifuge for 1 minute and the resulting cell pellet resuspended in 1 ml 2×TY (16 g Tryptone, 10 g Yeast Extract and 5 g NaCl in 1 litre, autoclaved for 15 minutes at 121° C.) and plated onto a 9 cm Petri dish containing TYE media supplemented with 15 µg/ml tetracycline. The plates were incubated overnight at 37° C. then 2 ml of 2×TY supplemented with 15% glycerol was added to each plate and cells loosened with a glass spreader and mixed thoroughly. Fifty microlitres of the scraped bacteria was used to inoculate 50 ml of 2×TY supplemented with 15 µg/ml tetracycline and grown overnight at 37° C. with shaking at 250 rpm. The overnight culture was centrifuged at 3,300 g for 15 mM to pellet the bacteria. To precipitate phage, 10 ml PEG/NaCl (20% Polyethylene glycol 8000, 2.5 M NaCl) was added to 40 ml supernatant. The phage/PEG solution was mixed and left on ice for 1 h, then spun at 3,300 g for 30 min at 4° C. and the supernatant discarded. The pellet was resuspended in 2 ml PBS and spun at 11,600 g for 10 mM in a micro centrifuge to remove the remaining bacterial debris. The resultant supernatant containing phage was then used for the next round of selection against the appropriate concentration of biotinylated CD40L monomer triple mutant antigen.

Phage ELISA

Monoclonal phage ELISAs were carried out following selection rounds 2 and 3. All washes were performed using 3 washes of 250 µl PBST followed by 3 washes of 250 µl PBS. The plates were coated overnight at 4° C. with 50 µl/well of 1 µg/ml NeutrAvidin [Thermo Scientific, UK] in 0.2M carbonate-bicarbonate buffer, pH 9.4. The plates were washed and then blocked with 2% MPBS for 1 hour at room temperature. The plates were then washed and incubated with 50 µl/well of ~1.0 µg/ml biotinylated human CD40L monomer triple mutant in 2% MPBS. The plates were washed and 25 µl/well phage supernatants added to an equal volume of 2% MPBS and incubated for 1 hour at room temperature. The plates were washed and bound phage detected with 50 µl/well anti-M13-HRP conjugate [GE Healthcare, UK] diluted 1:5000 in 2% MPBS and incubated for 1 hour at room temperature. The plates were washed and the ELISA developed using 50 µl/well SureBlue 1-Component TMB Micro Well Peroxidase solution [KPL Inc, USA]. The colorimetric reaction was stopped by the addition of an equal volume of 1 M HCl and the ELISA plate read at 450 nm. Specific phage were identified by comparison to wells coated with NeutrAvidin but without biotinylated CD40L monomer triple mutant.

Recovery of dAb Genes from MidiPrep pDOM4 Plasmid

The dAb V-genes from the following round 3 outputs were recovered by DNA restriction enzyme digestion of the phage vector pDOM4:
 a) 4G $V_H$ CDR3 lengths between 7-10 amino acids (50 nM antigen concentration).
 b) 4G $V_H$ CDR3 lengths between 11-15 amino acids (50 nM antigen concentration).
 c) 4G $V_H$ CDR3 lengths between 11-15 amino acids (5 nM antigen concentration).
 d) 4G $V_H$ CDR3 lengths between 7-15 amino acids (50 nM antigen concentration).
 e) 4G VK (50 nM antigen concentration).
 f) 4G VK (5 nM antigen concentration).
 g) 6G $V_H$ CDR3 lengths between 7-9 (50 nM antigen concentration).
 h) 6G $V_H$ CDR3 lengths between 10-15 (5 nM antigen concentration).

Approximately 20 µg of MidiPrep [Qiagen, UK] DNA was digested with SalI and NotI as follows: 20 µl DNA (~1 µg/µl) was mixed with 1.5 µl SalI (20 U/µl) [NEB, UK] and 3 µl NotI (10 U/µl) [NEB, UK], 4 µl Buffer 3 [NEB, UK], 0.4 µl BSA (10 mg/ml) [NEB, UK] and tissue culture grade water [Sigma, UK] added to 40 µl. Samples were incubated for 5 hours at 37° C. in an air incubator following which the digested dAb genes were isolated by running the digestion mix on a 2% agarose gel [E-gel, Invitrogen, UK], the appropriate DNA bands excised and cleaned using a PCR purification kit [Qiagen, UK]. The purified V-genes were ligated into a SalI and NotI double digested pDOM5 expression vector.

Soluble dAb ELISA

Binding dAbs were identified as follows. Ninety-six individual colonies containing dAb V-genes cloned into the soluble dAb expression vector pDOM5 were picked from each output into 200 µl Terrific Broth containing OnEx Autoinduction media [Novagen, UK] and incubated overnight at 37° C. with shaking at 250 rpm in Costar 96 Well Cell Culture Clusters [Corning Incorporated, USA] sealed with a gas permeable adhesive plastic strip. The cultures were centrifuged to pellet the cells and the supernatants assayed by antigen binding ELISA for dAbs that bound to CD40L monomer triple mutant and IZ-CD40L mutant (CD40L containing an isoleucine zipper trimerization domain, supplied by Bristol-Myers Squibb). MaxiSorp 96 well immunoplates [Nunc, USA] were coated overnight at 4° C. with 50 µl/well of 1 µg/ml NeutrAvidin in 0.2 M carbonate-bicarbonate buffer, pH 9.4. All washes were as described for the phage ELISA. The plates were blocked for 1 hour at room temperature with 200 µl of PBS containing 1% Tween 20. The plate was then washed and incubated for 1 hour at room temperature with 50 µl/well of 1 µg/ml biotinylated human CD40L monomer triple mutant in PBST or 1 µg/ml biotinylated human IZ-CD40L mutant in PBST (both antigens supplied by Bristol-Myers Squibb). The ELISA plate was washed and dAb-containing culture supernatant clarified by centrifugation at 1,800 g for 10 min at 4° C., then added to the ELISA plate (30 µl/well) to which was added an equal volume of PBST. The plates were incubated for 1 hour at room temperature and then washed. Bound dAb was detected by adding 50 µl/well 9E10 [anti-myc IgG, Sigma-Aldrich, UK] diluted 1:2000 in PBST and incubating for 1 hour at room temperature; the ELISA plate was then washed and 50 µl/well anti-mouse Fc-HRP [Sigma-Aldrich, UK] diluted 1:2000 in PBST added and incubated for 1 hour at room temperature. The plates were washed and the ELISA developed by adding 50 µl/well Sure-Blue 1-Component TMB MicroWell Peroxidase solution [KPL Inc, USA] and the colour allowed to develop. The colourimetric reaction was stopped by the addition of an equal volume of 1 M HCl and the ELISA plate read at 450 nm. Antigen binding dAbs were identified by comparison of the signal intensity from human CD40L monomer triple mutant and human IZ-CD40L mutant wells with control wells not containing antigen.

Expression & Purification of dAb at 50 ml Scale

Unique dAbs were identified by DNA sequencing ELISA positive clones. The unique dAbs identified were expressed as follows in 250 ml baffled flasks, to which was added:
a) 50 ml of Terrific Broth [Sigma-Aldrich, UK].
b) 100 µg/ml carbenicillin [Sigma-Aldrich, UK].
c) 1 drop of antifoam A204 [Sigma-Aldrich, UK].
d) Novagen Overnight Express Autoinduction Kit [Novagen, UK].

A bacterial scrape from a fresh confluent 9 cm diameter agar plate or from a glycerol stock of the desired dAb clone was used to inoculate the Terrific Broth, then the flask sealed with Milliwrap PTFE membrane [Millipore, UK], and incubated for 48 hrs, 250 rpm shaking at 30° C. The bacterial overnight culture was clarified by centrifugation and the $V_H$ or VK dAb purified using Streamline Protein A [GE Healthcare, UK] or Protein L agarose [generated in-house] respectively. The resulting purified proteins were assayed by RBA to determine which clones could inhibit the binding of CD40L for CD40.

CD40L Bead Receptor Binding Assay

Inhibitory dAbs were initially identified by screening purified dAb in a CD40L bead receptor binding assay (RBA). Sphero streptavidin polystyrene beads (0.5% w/v, 6.7 µm diameter) [Saxon, Europe] were prepared and washed according to the manufacturer's instructions. The beads were then pelleted at 11,600 g for 1 minute, the supernatant discarded and the beads resuspended in 1 ml PBS by vortexing. The washing step was repeated twice more, the supernatant discarded and the beads resuspended in 1 ml (0.5 mg/ml) of biotinylated human IZ-CD40L in PBS and incubated overnight at room temperature with end-over-end rotation. Following incubation, the beads were pelleted and washed three times with 1 ml PBS as before and then resuspended in 0.5 ml PBS containing 0.1% bovine serum albumin (BSA). The antigen coated beads were then diluted 1:10 in PBS containing 0.1% BSA prior to use. The reagents for the RBA assay were added as follows to duplicate wells in a 384-well black sided clear bottomed FMAT plate [Applied Biosystems, UK]:
a) 12.5 µl dAb protein or buffer control. The dAb titration starting concentration was typically 10 µM (final concentration) which was diluted 1:3.3 (i.e., 30 µl sample added to 70 µl PBS containing 0.1% BSA) to produce an 8-point titration effect curve.
b) 12.5 µl CD40-Fc [supplied by Bristol-Myers Squibb, USA; lot CY24Feb06-1] at 0.2 µg/ml (for a final concentration of 0.05 µg/ml) diluted in PBS containing 0.1% BSA.
c) 12.5 µl Mixture of mouse anti-human Fc [Sigma-Aldrich, UK] at 2 µg/ml (for a final concentration of 0.5 µg/ml) and goat anti-mouse Alexa Fluor 647 [Invitrogen, UK] at 1 µg/ml (for a final concentration of 0.25 µg/ml) diluted in PBS containing 0.1% BSA.
d) 12.5 µl IZ-CD40L coated beads described above were added to the centre of the well so they did not disperse to the edge of the well.

Following addition of the reagents to the 384 well plate, it was incubated at room temperature for 6 hours in the dark and then read in an AB8200 FMAT system [Applied Biosystems, UK].

Example 2 dAb Selection for Clone BMS2h-572

Three rounds of selection using decreasing concentrations of antigen (300 nM at round 1; 30 nM at round 2; 3 nM at round 3) were performed in parallel against biotinylated (1.42 moles biotin/mole timer) human isoleucine zipper-CD40L (IZ-hCD40L) provided by Bristol-Myers Squibb. Phage from the naïve 4G and 6G Domantis dAb libraries were combined into the pools a) to h) indicated below before initiating selections:
a) 4G $V_H$ CDR3 lengths between 7-9 amino acids.
b) 4G $V_H$ CDR3 lengths between 10-12 amino acids.
c) 4G $V_H$ CDR3 lengths between 13-15 amino acids.
d) 4G VK
e) 6G $V_H$ CDR3 lengths between 7-9
f) 6G $V_H$ CDR3 lengths between 10-12
g) 6G $V_H$ CDR3 lengths between 13-15
h) 6G VK Each round of selection involved adding the desired concentration of biotinylated CD40L to a mixture of phage (from one of the naïve library pools indicated above, or subsequent selection output phage) in 1000 µl of 2% MPBS (Phosphate Buffered Saline containing 2% (w/v) Marvel [Premier Foods, UK]) and incubating at room temperature for 1 hour by mixing end-over-end. The biotinylated antigen phage complex was then captured by adding 100 µl of resuspended Dynabeads M-280 Streptavidin [Invitrogen, UK] (rounds 1 and 3) or 50 µl of M-280 tosylactivated Dynabeads (Invitrogen) that had been coupled with NeutrAvidin [Thermo Fisher Scientific, UK] (round 2) and incubated for 5 minutes with mixing end-over-end at room temperature. The Dynabeads were then recovered using a KingFisher magnetic separator [Thermo Fisher Scientific, UK] and washed 7×1 ml PBST (PBS containing 0.1% (v/v) polyoxyethylenesorbitan 20 monolaurate [Sigma-Aldrich, UK]) followed by 1×1 ml PBS. Bound phage retained on the washed Dynabeads were eluted by incubation with 500 µl of trypsin-PBS (50 µl of 10 mg/ml trypsin [Sigma-Aldrich, UK] dissolved in 50 mM Tris-HCl pH 7.4, 1 mM $CaCl_2$ added to 450 µl PBS). The phage-containing solution was recovered and 250 µl used to infect 1.75 ml of logarithmic growth phase E. coli TG1 (at an $OD_{600}$ of 0.4) for 30 minutes at 37° C. The E. coli TG1 phage infected culture was centrifuged at 11,600 g in a micro centrifuge for 1 minute and the resulting cell pellet resuspended in 1 ml 2×TY (16 g Tryptone, 10 g Yeast Extract and 5 g NaCl in 1 litre, autoclaved for 15 minutes at 121° C.) and plated onto a 9 cm Petri dish containing TYE media supplemented with 15 ng/ml tetracycline. The plates were incubated overnight at 37° C. then 2 ml of 2×TY supplemented with 15% glycerol was added to each plate and cells loosened with a glass spreader and mixed thoroughly. Fifty microlitres of the scraped bacteria was used to inoculate 50 ml of 2×TY supplemented with 15 µg/ml tetracycline and grown overnight at 37° C. with shaking at 250 rpm. The overnight culture was centrifuged at 3,300 g for 15 min to pellet the bacteria. To precipitate phage, 10 ml PEG/NaCl (20% Polyethylene glycol 8000, 2.5 M NaCl) was added to 40 ml supernatant. The phage/PEG solution was mixed and left on ice for 1 h, then spun at 3,300 g for 30 min at 4° C. and the supernatant discarded. The pellet was resuspended in 2 ml PBS and spun at 11,600 g for 10 min in a micro centrifuge to remove the remaining bacterial debris. The resultant supernatant containing phage was then used for the next round of selection against the appropriate concentration of biotinylated IZ-hCD40L.

Phage ELISA

Monoclonal phage ELISAs were carried out following selection rounds 2 and 3. All washes were performed using 3 washes of 250 µl PBST followed by 3 washes of 250 µl PBS. The plates were coated overnight at 4° C. with 50 µl/well of 1 µg/ml IZ-hCD40L in PBS. The plates were washed and then blocked with 2% MPBS for 1 hour at room temperature. The plates were washed and 25 µl/well phage supernatants added to an equal volume of 2% MPBS and incubated for 1 hour at room temperature. The plates were washed and bound phage detected with 50 µl/well anti-M13-HRP conjugate [GE Healthcare, UK] diluted 1:5000 in 2% MPBS and incubated for 1 hour at room temperature. The plates were washed and the ELISA developed using 50 µl/well SureBlue 1-Component TMB Micro Well Peroxidase solution [KPL Inc, USA]. The colorimetric reaction was stopped by the addition of an equal volume of 1 M HCl and the ELISA plate read at 450 nm. Specific phage were identified by comparison to wells that were not coated with antigen but otherwise identically treated.

Recovery of dAb Genes from pDOM4 Plasmid

The dAb V-genes from round 2 and 3 outputs were recovered by SalI and NotI restriction enzyme digestion of the phage vector pDOM4 and ligated into a SalI and NotI double digested pDOM5 expression vector.

Soluble dAb ELISA

Binding dAbs were identified as follows. Ninety-six individual colonies containing dAb V-genes cloned into the soluble dAb expression vector pDOM5 were picked from each output into 200 µl Terrific Broth containing OnEx Auto-induction media [Novagen, UK] and incubated overnight at 37° C. with shaking at 250 rpm in Costar 96 Well Cell Culture Clusters [Corning Incorporated, USA] sealed with a gas permeable adhesive plastic strip. The cultures were centrifuged to pellet the cells and the supernatants assayed by antigen binding ELISA for dAbs that bound to IZ-hCD40L. MaxiSorp 96 well immunoplates [Nunc, USA] were coated overnight at 4° C. with 50 µl/well of 1 µg/ml IZ-hCD40L in PBS. All washes were as described for the phage ELISA. The plates were blocked for 1 hour at room temperature with 200 µl of PBS containing 1% Tween 20. The ELISA plate was washed and dAb-containing culture supernatant clarified by centrifugation at 1,800 g for 10 min at 4° C., then added to the ELISA plate (30 µl/well) to which was added an equal volume of PBST. The plates were incubated for 1 hour at room temperature and then washed. Bound dAb was detected by adding 50 µl/well 9E10 [anti-myc IgG, Sigma-Aldrich, UK] diluted 1:2000 in PBST and incubating for 1 hour at room temperature; the ELISA plate was then washed and 50 µl/well anti-mouse Fc-HRP [Sigma-Aldrich, UK] diluted 1:2000 in PBST added and incubated for 1 hour at room temperature. The plates were washed and the ELISA developed by adding 50 µl/well SureBlue 1-Component TMB MicroWell Peroxidase solution [KPL Inc, USA] and the colour allowed to develop. The colorimetric reaction was stopped by the addition of an equal volume of 1 M HCl and the ELISA plate read at 450 nm. Antigen binding dAbs were identified by comparison of the signal intensity from IZ-hCD40L wells with control wells not containing antigen.

Example 3

Identification of Clones BMS2h-503-1, BMS2h-719-2, and BMS2h-572-6

BMS2h-503, BMS2h-719 and BMS2h-572 dAbs were subjected to error-prone affinity maturation to generate BMS2h-503, BMS2h-719 and BMS2h-572 lineages, respectively. This was performed using random mutagenesis where on average 3.6 amino acid changes were introduced per dAb. Phage libraries (average size $6 \times 10^8$) were selected using biotinylated monomeric and trimeric human CD40L with alternating streptavidin/neutravidin bead capture of the antigen (as described). Three rounds of selections using decreasing concentrations of antigen (100 nM at round 1; 10 nM at round 2; 1 nM at round 3) were performed. Sequencing was used to monitor diversity following each selection round. Selection outputs (round 2 selected on CD40L trimer for BMS2h-572; round 3 selected on CD40L trimer for BMS2h-503 and round 3 selected on CD40L monomer for BMS2h-

719) were sub-cloned into soluble expression vector pDOM13 (no C terminal tag) (as described) and screened as monoclonal bacterial micro-culture supernatants by BIAcore for improved off-rates compared to parental clones on both monomeric and trimeric CD40L. Identified improved variants were DNA sequenced and unique dAbs expressed, purified and then assayed using the BMS2h bead RBA as well as cellular CD40L driven assays (as described). As a result, BMS2h-503-1 (sequence listed in TABLE 3), BMS2h-719-2 and BMS2h-572-6 dAbs (sequences listed in TABLE 1) were identified. Activities of these dAbs are listed in TABLE 5 below.

Formatting BMS2h-503-1, BMS2h-719-2 and BMS2h-572-6 as Fc Fusions

BMS2h-572-6, BMS2h-503-1 and BMS2h-719-2 dAbs were cloned into pDOM38 vector containing Fc tail derived from human IgG1 to create DMS0502, DMS0500 and DMS0501, respectively. BMS2h-572-6, BMS2h-503-1 and BMS2h-719-2 dAbs were also cloned into pDOM38 vector containing Fc tail derived from human IgG4 to create DMS0505, DMS0506 and DMS0504, respectively. The constructs were transiently expressed in HEK293 cells and the proteins were purified using Protein A. Purified Fc fusions were analysed by Biacore for binding to monomeric and trimeric CD40L as well as in various cell assays (as described).

Identification of Clones BMS2h-572-608, BMS2h-572-614 and BMS2h-572-619

BMS2h-572-6 dAb was subjected to affinity maturation using doped oligo approach. Four doped libraries were constructed for this dAb:
Library 1-5 residues in CDR1 diversified
Library 2-6 residues in CDR2 diversified
Library 3-13 residues in CDR2 diversified
Library 4-7 residues in CDR3 diversified
In each library, diversification was performed using nnS codons where n retained a large fraction of the parent base (85%) and split the rest between the equimolar amounts of the remaining three bases (5% each) and S stood for G or C. Phage libraries (average size $8\times10^8$) were selected using biotinylated monomeric and trimeric human CD40L with alternating streptavidin/neutravidin bead capture of the antigen (as described). Libraries 2 and 3 were pulled together during the selection process. Three rounds of selections using decreasing concentrations of antigen (50 nM at round 1; 5 nM at round 2; 1 nM at round 3 with 200 fold excess of competitor—non biotinylated CD40L trimer) were performed. Sequencing was used to monitor diversity following each selection round. Selection outputs (rounds 2 and 3) were sub-cloned into soluble expression vector pDOM13 (no C terminal tag) (as described) and screened as monoclonal bacterial micro-culture supernatants by BIAcore for improved off-rates compared to parental clones on both monomeric and trimeric CD40L. Identified improved variants were DNA sequenced and unique dAbs expressed, purified and then assayed using the BMS2h bead RBA as well as cellular CD40L driven assays (as described). As a result, BMS2h-572-608, BMS2h-572-614 and BMS2h-572-619 dAbs were identified.

Construction of Clone BMS2h-572-633

Sequence analysis revealed that all of the amino acid differences between BMS2h-572-608 and the parental dAb BMS2h-572-6 were located in CDR1 and the differences between BMS2h-572-614 and parental dAb BMS2h-572-6 were located in CDR3. Both matured dAbs shared CDR2 with the parental dAb BMS2h-572-6. This created an opportunity to construct a combination mutant which had CDR1 of BMS2h-572-608 and CDR3 of BMS2h-572-614. Firstly, CDR1 region of BMS2h-572-608 was PCR amplified. Secondly, CDR2+CDR3 fragment of BMS2h-572-614 was PCR amplified. This was followed by SOE PCR assembly of the two fragments to create a combination mutant BMS2h-572-633. The assembled dAb PCR product was cloned into soluble expression vector pDOM13 (no C terminal tag), sequence verified, expressed, purified and then assayed using the BMS2h bead RBA as well as cellular CD40L driven assays (as described).

Formatting BMS2h-572-633 as Fc Fusion

BMS2h-572-633 dAb was cloned into pDOM38 vector containing Fc tail derived from human IgG1 to create DMS0507. The construct was transiently expressed in HEK293 cells and the protein was purified using Protein A. Purified Fc fusion was analysed by Biacore for binding to monomeric and trimeric CD40L as well as in various cell assays (as described).

Example 4

CD40L Activity Cell Assays

Anti-human CD40L dAbs were assayed functionally for their ability to antagonize CD40L activities. The CD40L activities tested were B cell proliferation and cytokine production by hCD40L-driven activation of primary monocytes-derived dendritic cells (DCs). Unless otherwise noted, all assays were performed in RPMI media supplemented with 10% fetal calf serum (FCS). The results of various assays, described in detail below, are shown in TABLE 5 and TABLE 6.
Soluble IZ-hCD40L-Driven Primary Human B Cell Proliferation:
$1\times10^5$ tonsillar human B cells were incubated with 0.6 µg/ml of IZ-hCD40L along with varying titration of dAb or mAb in a final volume of 2000/well in a 96-well round bottom plate. The plates were incubated at 37° C. for 72 hours following which thymidine ($^3$H, 0.5 µci/well) was added for 6 hours. B cell proliferation was quantified based on thymidine incorporation. All assays, unless otherwise noted, were performed in RPMI media supplemented with 10% fetal calf serum (FCS).
CHO-hCD40L-Driven Primary Human B Cell Proliferation:
CHO cells were transfected with human CD40L to generate a stable cell line expressing high levels of CD40L on the cell surface. CHO-CD40L cells were irradiated at 10,000 Rads before incubation with human B cells. $1\times10^5$ tonsillar human B cells were incubated with $1\times10^3$ CHO-CD40L cells (1:100 ratio of CHO-CD40L: human B cells) along with varying titration of dAb or mAb in a final volume of 200 µl/well in a 96-well round bottom plate. The plates were incubated at 37° C. for 72 hours following which thymidine ($^3$H, 0.5 µci/well) was added for 6 hours. B cell proliferation was quantified based on thymidine incorporation. All assays, unless otherwise noted, were performed in RPMI media supplemented with 10% fetal calf serum (FCS).
Primary T Cell-Driven Human B Cell Proliferation:
T cells were isolated from human peripheral blood mononuclear cells (PBMCs) and enriched using via sheep red blood cell (SRBC) affinity. Enriched human T cells were cultured with PM-LCLs (EBV-transformed B cell line; irradiated at 10,000 Rads) at a 5:1 ratio (T:LCL) for 6 days at 37° C. to generate a population of allogeneic T cells. At day 6, the expanded T cells were isolated and irradiated at 3000 Rads, and then cultured ($5 \times 10^4$ T cells/well) with primary human tonsillar B cells ($1 \times 10^5$ B cells/well) at a 1:2 ratio in 96-well flat bottom plated coated with anti-CD3 mAb (OKT3). Varying titrations of dAbs/mAbs were added to each well; the final volume in each well was 200 µl. Test plates were incubated at 37° C. for 3 days. Human B cell proliferation was determined via the addition of thymidine ($^3$H, 0.5 µci/well) to the cultures for the last 18 hours. All assays, unless otherwise noted, were performed in RPMI media supplemented with 10% fetal calf serum (FCS). In some instances, the supernatant was harvested and measured for the presence of IL-6.

CHO-hCD40L-Driven Activation of Primary Human Monocytes-Derived Dendritic Cells (DCs):

Human PBMCs were enriched for monocytes by depleting T cells via SRBC resetting. The monocyte-enriched PBMCs were cultured with 10 ng/ml GM-CSF and 5 ng/ml IL-4 in E-well plates for six days at 37° C. The cultured plates were replenished with fresh media (with GM-CSF and IL-4) on days 2 and 5. The immature DCs were used in cell assays on day 6. $8 \times 10^4$ immature DCs were cultured with $4 \times 10^3$ CHO-hCD40L cells (irradiated at 10,000 Rads) along with varying titrations of dAbs/mAbs in a 96-well flat bottom plate. After 24 hours, supernatants were harvested and tested for the presence of various cytokines (IL-12, TNF, IL-23). DC activation was determined by the levels of cytokine production. All assays, unless otherwise noted, were performed in RPMI media supplemented with 10% fetal calf serum (FCS).

TABLE 5

Potency of Monomeric dAb Molecules in Various Primary Cell Assays

| Clone | hIZCD40L-driven Human B Cell Proliferation EC50 (nM) | CHO-hCD40L-driven Human B Cell Proliferation EC50 (nM) | T-B cell MLR EC50 (nM) | CHO-hCD40L-driven DC Activation IL-12 EC50 (nM) |
|---|---|---|---|---|
| 2h116-13 | 130.0 ± 40.0 | 1300.0, 700.0 | | 888.0, >2000.0, 1000.0 |
| 2h116-1312 | 23.0 ± 3.0 | 530.0 ± 300.0 | 234 ± 46 | 112.0 ± 47.0 |
| 2h116-1313 | 29.0 ± 4.0 | 211.0, 334.0 | 258 ± 79 | 136.0 ± 51.0 |
| 2h116-1314 | 41.0 ± 10.0 | 1300.0, 4400.0 | 1687 ± 1150 | 664.0 ± 353.0 |
| 2h116-1319 | 180.0 ± 57.0 | >7000.0 | | |
| 2h116-1320 | 20.0 ± 7.0 | 138.0 ± 60.0 | 191 ± 72 | 32.0 ± 10.0 |
| 2h437 | 5700.0 ± 1800 | | | |
| 2h437-4 | 203.0 ± 90.0 | >7000.0 | | 1329.0 ± 412.0 |
| 2h492 | >7000.0 | | | |
| 2h492-3 | 1100.0 ± 400.0 | >7000.0 | | |
| 2h492-4 | 1700.0 ± 900.0 | >7000.0 | | |
| 2h492-5 | 2300.0 ± 700.0 | | | |
| 2h492-6 | 6300.0 ± 1400.0 | | | |
| 2h492-7 | 1900.0 ± 600.0 | | | |
| 2h494 | 6100.0 ± 1200.0 | | | |
| 2h494-2 | 4800.0 ± 2300.0 | | | |
| 2h494-3 | >7000.0 | | | |
| 2h494-4 | 590.0 ± 250.0 | >7000.0 | | |
| 2h494-6 | 2000.0 ± 2100.0 | >7000.0 | | |
| 2h503 | 4200.0 ± 316.0 | >7000.0 | | |
| 2h503-1 | 24.0 ± 2.0 | 2300.0 ± 700.0 | | 756.0 ± 333.0 |
| 2h503-104 | 16.0, 19.0 | | | |
| 2h503-2 | 44.0 ± 6.0 | 3000.0 ± 1000.0 | | 1562.0 ± 96.0 |
| 2h572 | >7000.0 | | | |
| 2h572-6 | 208.0 ± 73.0 | >7000.0 | >7000.0 | >2000.0, 608.0 ± 260.0 |
| 2h572-604 | 254.0, 354.0 | >700.0 | | 387.0 |
| 2h572-608 | 96.0 ± 19.0 | | >7000.0 | 152.0 ± 61.0 |
| 2h572-610 | 109.0 ± 34.0 | | >7000.0 | 207.0 ± 87.0 |
| 2h572-614 | 93.0 ± 53.0 | | >7000.0 | 135.0 ± 54.0 |
| 2h572-616 | 204.0, 340.0 | | >7000.0 | 608.0 ± 136.0 |
| 2h572-617 | 157.0, 189.0 | | >7000.0 | 338.0 ± 101.0 |
| 2h572-619 | 90.0 ± 62.0 | 421.0, 1496.0 | >7000.0 | 188.0 ± 41.0 |
| 2h572-622 | 301.0, 293.0 | | >7000.0 | 281.0 ± 127.0 |
| 2h572-623 | 181.0, 261.0 | | >7000.0 | 280.0 ± 73.0 |
| 2h572-630 | 103.0 ± 71.0 | | | 246.0 ± 240.0 |
| 2h572-631 | 108.0 ± 77.0 | | | 230.0 ± 200.0 |
| 2h572-632 | 117.0 ± 91.0 | | | 241.0 ± 190.0 |
| 2h572-633 | 20.0 ± 15.0 | | | 53.0 ± 60.0 |
| 2h572-634 | 31.0 ± 18.0 | | | 77.0 ± 67.0 |
| 2h572-635 | 29.0 ± 19.0 | | | 52.0 ± 26.0 |
| 2h572-9 | 324.0, 243.0 | | | >2000.0 |
| 2h572-11 | 140.0 ± 33.0 | >7000.0 | | 671.0 ± 165.0 |
| 2h572-12 | 79.0, 76.0 | | | 225.0, >2000.0 |
| 2h572-14 | 134.0 ± 12.0 | >7000.0 | | 882.0 ± 310.0 |
| 2h572-15 | 168.0 ± 67.0 | >7000.0 | | 876.0 ± 391.0 |
| 2h572-22 | 357.0, 305.05 | | | |
| 2h702 | >7000.0 | | | |
| 2h703 | >7000.0 | | | |
| 2h706 | >7000.0 | | | |
| 2h707 | >7000.0 | | | |

TABLE 5-continued

Potency of Monomeric dAb Molecules in Various Primary Cell Assays

| Clone | hIZCD40L-driven Human B Cell Proliferation EC50 (nM) | CHO-hCD40L-driven Human B Cell Proliferation EC50 (nM) | T-B cell MLR EC50 (nM) | CHO-hCD40L-driven DC Activation IL-12 EC50 (nM) |
|---|---|---|---|---|
| 2h710 | >7000.0 | | | |
| 2h712 | >7000.0 | | | |
| 2h717 | >7000.0 | | | |
| 2h719 | 600.0 ± 640.0 | | | 134.0, 646.0 |
| 2h719-2 | 82.0 ± 39.0 | >7000.0 | | 196.0 ± 150.0 |
| 2h719-202 | 29.0 ± 12.0 | | | 79.0 ± 29.0 |
| 2h719-203 | 81.0, 96.0 | | | |
| 2h719-213 | 62.0, 98.0 | | | |
| 2h719-214 | 66.0, 89.0 | | | |
| 2h719-215 | 92.0, 91.0 | | | |
| 2h719-218 | 57.0, 60.0 | | | |
| 2h719-225 | 253.0, 198.0 | | | 176.0 ± 84.0 |
| 2h719-226 | 164.0, 247.0 | | | 812.0 ± 53.0 |
| 2h719-12 | 358.0 ± 159.0 | | | 266.0 ± 66.0 |
| 2h719-13 | 50.0 ± 8.0 | 659.0, 683.0, 4450.0, 1750.0 | | 219.0 ± 88.0 |
| 2h719-17 | 132.0 ± 50.0 | 236.0, 268.0 | | 113.0 ± 49.0 |
| 2h719-19 | 138.0 ± 31.0 | 202.0, >7000.0, >7000.0, 3800.0, 5400.0 | | 184.0 ± 99.0 |
| 2h722 | >7000.0 | | | |
| 2h723 | >7000.0 | | | |
| 2h725 | 6400.0 ± 1200.0 | | | |
| 2h725-2 | >7000.0 | | | |
| 2h725-9 | >7000.0 | | | |
| 2h725-19 | >7000.0 | | | |
| 2h726 | >7000.0 | | | |
| 2h730 | >7000.0 | | | |
| 2h731 | 5800.0 ± 2500.0 | | | |
| 2h744 | >7000.0 | | | |
| 2h745 | 6400.0, 3500.0, >7000.0 | | | |
| 2h745-1 | >7000.0 | | | |
| 2h745-2 | >7000.0 | | | |
| 2h745-9 | >7000.0 | | | |
| 2h745-13 | >7000.0 | | | |
| 2h745-14 | >7000.0 | | | |
| 2h746 | >7000.0 | | | |
| 2h747 | >7000.0 | | | |
| 2h752 | >7000.0 | | | |
| 2h754 | 6600.0 ± 900.0 | | | |
| 2h757 | 6400.0 ± 800.0 | | | |
| 2h758 | 5900.0 ± 1500.0 | | | |
| 2h758-1 | >7000.0 | | | |
| 2h758-2 | >7000.0 | | | |
| 2h758-3 | >7000.0 | | | |
| 2h758-4 | >7000.0 | | | |
| 2h758-5 | >7000.0 | | | |
| 2h765 | >7000.0 | | | |
| 2h766 | >7000.0 | | | |
| 2h774 | >7000.0 | | | |
| 2h775 | >7000.0 | | | |
| 2h780 | >7000.0 | | | |
| 2h781 | >7000.0 | | | |
| 2h782 | >7000.0 | | | |
| 2h783 | >2000.0 | | | |
| 2h784 | >4700.0 | | | |
| 2h785 | 3700.0, >7000.0 | | | |

TABLE 6

Potency of Fc*-formatted Molecules in Various Primary Cell Assays

| Clone | hIZCD40L-driven Human B Cell Proliferation EC50 (nM) | CHO-hCD40L-driven Human B Cell Proliferation EC50 (nM) | T-B cell MLR EC50 (nM) | T-B cell MLR IL-6 EC50 (nM) | CHO-hCD40L-driven DC Activation IL-12 EC50 (nM) | CHO-hCD40L-driven DC Activation IL-6 EC50 (nM) | CHO-hCD40L-driven DC Activation IL-23 EC50 (nM) | CHO-hCD40L-driven DC Activation TNF EC50 (nM) |
|---|---|---|---|---|---|---|---|---|
| 2h116-1320-Fc | 13.0 ± 2.0 | >130.0 | 244.0 ± 112.0 | | 14.0 ± 11.0 | | | |
| 2h503-1 Fc | 4.0 ± 0.5 | 60.0 ± 20.0 | 45 ± 6 | | 2.8 ± 2.0 | | | |
| 2h503-1 IgG1 | 4.5 ± 1.0 | 67.0 ± 40.0 | 39.5 ± 12.04 | | 1.4 ± 0.7 | | | |
| 2h503-1 IgG4 | 2.5 ± 1.0 | 69.0 ± 50.0 | 48.3 ± 8.8 | | 18.1 ± 6.4 | | | |
| 2h572-6 Fc | 0.6 ± 0.4 | 3.0 ± 1.0 | 1.9 ± 0.7 | | 0.22 ± 0.18 | | | |
| 2h572-6 IgG1 | 1.0 ± 0.4 | 10.0 ± 5.0 | 3.1 ± 1.4 | 2.9 ± 1.7 | 0.58 ± 0.36 | | | |
| 2h572-6 IgG4 | 0.9 ± 0.2 | 11.0 ± 5.0 | 3.2 ± 1.5 | 1.3 ± 0.5 | 1.1 ± 0.5 | | | |
| 2h572-6-CT Long Fc | 1.0 ± 0.5 | 6.0 ± 6.0 | 13.6 ± 9.2 | 8.1 ± 3.1 | 3.0 ± 1.9 | | | |
| 2h572-633 Fc | 3.5 ± 0.6 | 3.0 ± 3.0 | 0.15 ± 0.02 | 0.11 ± 0.02 | 0.34 ± 0.17 | | | |
| 2h572-634 Fc | 3.0 ± 0.0 | 3.5 ± 3.0 | 0.23 ± 0.08 | 0.19 ± 0.03 | 0.42 ± 0.05 | | | |
| 2h572-635 Fc | 2.0 ± 0.8 | 2.5 ± 1.0 | 0.16 ± 0.09 | 0.11 ± 0.02 | 0.445 ± 0.14 | | | |
| 2h572-619-Ctshort Fc | 1.5 ± 0.6 | 2.0 | 0.40 ± 0.1 | 0.3 ± 0.07 | 1.8 ± 1.3 | | | |
| 2h572-619-Ctlong Fc | 1.6 ± 0.5 | 2.0 ± 1.0 | 0.72 ± 0.45 | 0.43 ± 0.12 | 1.4 ± 0.6 | 1.5 ± 0.36 | 1.5 ± 0.46 | 2.0 ± 0.7 |
| 2h572-619-N297Qshort Fc | 0.9 ± 0 | 1.0 ± 0.6 | 0.226, 0.216 | 0.1, 0.1 | 1.2 ± 0.6 | | | |
| 2h572-619-N297Qlong Fc | 0.98 ± 0.05 | 2.0 ± 0.0 | 0.480, 0.474 | 0.22, 0.11 | 1.1 ± 0.23 | | | |
| 2h572-608-N297Qshort Fc | 1.0 ± 0.05 | 2.0 ± 0.0 | | | 0.93 ± 0.4 | | | |
| 2h572-608-CT Long Fc | 2.0 ± 1.0 | 2.0 ± 1.0 | 0.468 ± 0.156 | 0.38 ± 0.06 | 1.6 ± 0.74 | | | |
| 2h572-614-CT Long Fc | 2.0 ± 1.0 | 2.0 ± 0.5 | 0.283 ± 0.038 | 0.25 ± 0.02 | 1.4 ± 0.68 | | | |
| 2h572-633-CT Long Fc | 3.0 ± 0.7 | 1.0 ± 1.0 | 0.174 ± 0.077 | 0.13 ± 0.07 | 1.9 ± 1.3 | 1.3 ± 0.3 | 1.2 ± 0.3 | 1.7 ± 0.43 |
| 2h572-633-CT-Fc SP5 | 5.0 ± 0.5 | 1.0 ± 0.5 | 0.161 ± 0.053 | 0.13 ± 0.04 | 2.3 ± 1.5 | 1.5 ± 0.7 | | 2.9 ± 1.3 |
| 2h572-634-CT Long Fc | 2.0 ± 1.0 | 1.0 ± 0.6 | 0.162 ± 0.029 | 0.13 ± 0.02 | 1.5 ± 0.91 | | | |
| 2h572-635-CT Long Fc | 3.0 ± 1.0 | 2.0 ± 0.6 | 0.149 ± 0.014 | 0.13 ± 0.01 | 1.6 ± 0.93 | | | |
| 2h719-2 Fc | 1.0 ± 0 | 0.7 ± 0.4 | 6 ± 1.4 | | 0.13 ± 0.08 | | | |
| 2h719-2 IgG1 | 1.0 ± 0.5 | 6.0 ± 0.3 | 13.8 ± 10.6 | 2.2 ± 1.3 | 0.35 ± 0.23 | | | |
| 2h719-2 IgG4 | 1.5 ± 0.6 | 16.0 ± 13.0 | 15.9 ± 10.9 | 2.1 ± 0.7 | 1.1 ± 0.48 | | | |
| 2h719-202-N297Qshort Fc | 1.8 ± 0.5 | 1.7 ± 0.7 | | | 0.66 ± 0.26 | | | |
| 2h719-202-CT Long Fc | 3.0 ± 1.0 | 2.5 ± 0.6 | 1.7 ± 0.7 | 1.3 ± 0.3 | 3.1 ± 2.0 | | | |

*FIG. 3 provides sequences of various Fc domains. FIG. 4 shows examples of various Fc-formatted dAbs.

Example 5

Binding Kinetics and CD40L Affinity of Various Antibodies

BMS-986004 is a dimeric fusion protein, composed of a modified Fc fragment of IgG1 linked to the C-terminus of the dAb BMS2h-572-633. Surface plasmon resonance (SPR) was used to characterize the kinetics and affinity of BMS-986004 or the monovalent component domain antibody BMS2h-572-633 binding to CD40L. The BMS-986004 values were compared to those for the benchmark antibodies 5c8-IgG1 and 5c8-CT and the monovalent component 5c8 FAB fragment. The SPR experiments utilized a hCD40L construct containing an N-terminal isoleucine zipper motif (IZ-hCD40L) which facilitates the specific assembly of the CD40L molecule into the native trimeric form. A biotinylated version of IZ-hCD40L (biot-IZ-hCD40L) with equivalent binding activity was also utilized for some SPR experiments.

The monovalent BMS2h-572-633 domain antibody binds biot-IZ-hCD40L with a Kd of 7.8 nM, compared to an affinity of 5.4 nM for the monovalent 5c8 FAB fragment, TABLE 7. Because BMS-986004 is bivalent, and the IZ-hCD40L target is trivalent, the SPR binding data are influenced by avidity regardless of whether CD40L target is on the chip surface or in solution. To estimate the avidity-influenced binding affinity, the SPR data for BMS-986004 binding to a biot-IZ-hCD40L surface was fitted to a 1:1 Langmuir model, suggesting a dissociation constant of less than 1 nM, TABLE 7. Similar results were obtained for 5c8-IgG1 and 5c8-CT.

TABLE 7

IZ-hCD40L kinetic and affinity values as determined using SPR (Biacore)

| Anti-CD40L Ab | Temperature (° C.) | Model | ka (M-1s-1) | kd (s-1) | Kd (nM) |
|---|---|---|---|---|---|
| BMS-986004 | 25 | 1:1 Langmuir | 2.3E+06* | 2.6E−04* | 0.11* |
| 2h572-633 | 25 | 1:1 Langmuir | 1.0E+06 | 8.1E−03 | 7.8 |
| 5c8-IgG1 | 25 | 1:1 Langmuir | 5.4E+05* | 2.3E−04* | 0.42* |
| 5c8-CT | 25 | 1:1 Langmuir | 5.8E+05* | 1.3E−04* | 0.22* |
| 5c8 FAB fragment | 25 | 1:1 Langmuir | 1.4E+05 | 7.6E−04 | 5.4 |

*Value is influenced by avidity due to analyte bivalency.

Figure 5:
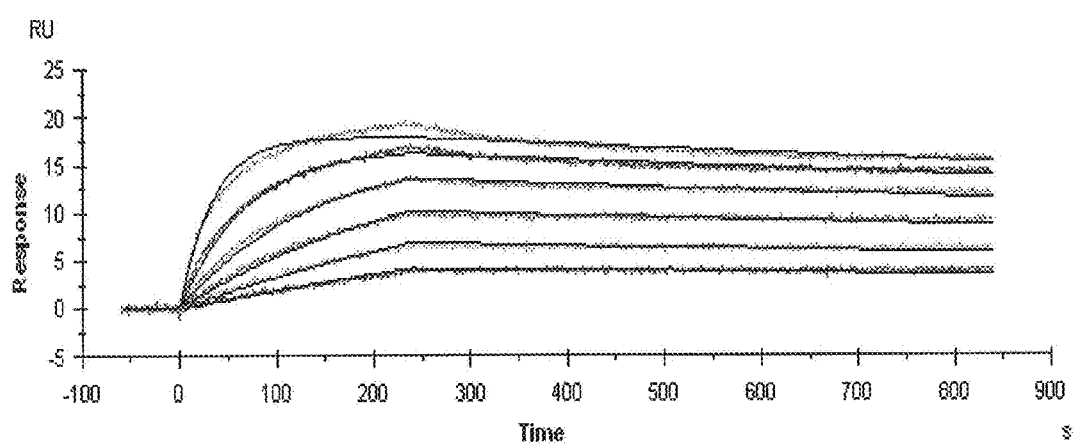
FIG. 5 depicts SPR sensorgram data for the binding of 12.5-0.39 nM BMS-986004 (2:1 dilution series) to biot-IZ-hCD40L captured on a streptavidin SPR sensor chip at 25° C. Colored lines show the double-referenced sensorgram data, and black lines show the 1:1 Langmuir fit to the data, with an avidity-influenced apparent Kd value of 0.11 nM.

FIG. 5 shows SPR sensorgram data for the binding of 12.5-0.39 nM BMS-986004 (2:1 dilution series) to biot-IZ-hCD40L captured on a streptavidin SPR sensor chip at 25° C. Colored lines show the double-referenced sensorgram data, and black lines show the 1:1 Langmuir fit to the data, with an avidity-influenced apparent Kd value of 0.11 nM.

Figure 6:
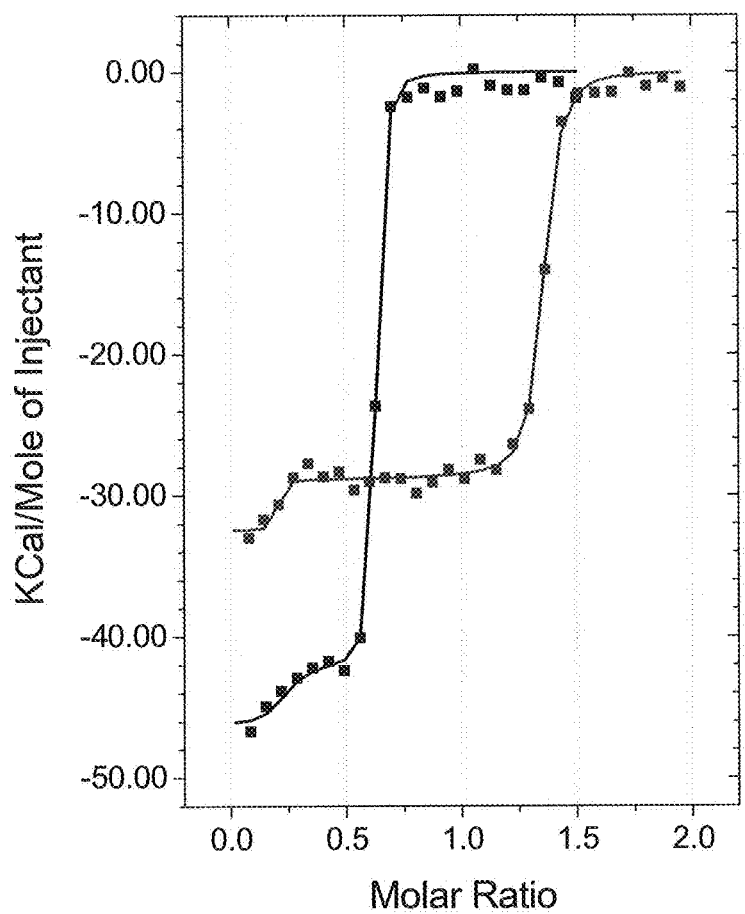
FIG. 6 shows ITC data for titrations of 19 µM IZ-hCD40L into 2 µM BMS-986004 (black) or 18 µM BMS-986004 into 2 µM IZ-hCD40L (blue). The molar ratio (apparent stoichiometry) is defined per mole of IZ-hCD40L trimer and per mole of bivalent BMS-986004 Fc-dimer. Molar ratio values obtained as the equivalence points on the abscissa suggest more than one mole of BMS-986004 can bind per mole of IZ-hCD40L trimer; however, an exact structural model for the complex cannot be determined from the ITC data alone. Squares represent the integrated heat of binding data and solid lines represent the best fit to a "2 sets of sites model."

The affinity and thermodynamics of BMS-986004 binding to CD40L were also characterized in solution using isothermal titration calorimetry (ITC) at temperatures ranging from 15-37° C. These data suggested the presence of multiple thermodynamically distinct binding modes (FIG. 6) with Kd values for the different modes beyond the high-affinity limit of detection (Kd<2 nM) (TABLE 8), consistent with the SPR data. The affinity of the monovalent 5c8 FAB fragment for IZ-hCD40L as determined by ITC (3.5 nM) was also consistent with the value determined by SPR.

TABLE 8

IZ-hCD40L affinity as determined using ITC

| Molecule in the ITC syringe | Molecule in the ITC cell | Kd (nM) |
|---|---|---|
| BMS-986004 | IZ-hCD40L | <2 |
| 5c8-CT | IZ-hCD40L | <2 |
| IZ-hCD40L | BMS-986004 | <2 |
| IZ-hCD40L | 5c8-CT | <2 |
| IZ-hCD40L | 5c8 FAB fragment | 3.5 |

Example 5

Fc Receptor Affinity of Various Antibodies

The Fc-domain of BMS-986004 (termed "CT") was engineered from a wild type IgG1 Fc domain to retain the ability to bind FcRn, but to disrupt the binding to Fcγ receptors. To confirm that the engineered molecule has the desired Fc receptor binding profile, the binding affinities of BMS-986004 for human FcRn, and the human Fcγ receptors CD64 (FcγRI), CD32a (FcγRIIa), CD32b/c (FcγRIIb/c), CD16a (FcγRIIIa), CD16b (FcγRIIIb) were measured using SPR, in comparison to 5c8-IgG1 and 5c8-CT. For these experiments, BMS-986004 was captured via the domain antibody domains on a biot-IZ-hCD40L sensor surface, and the soluble Fc receptor proteins were tested for binding to the exposed Fc domain. Likewise, 5c8-IgG1 and 5c8-CT were captured on a biot-IZ-hCD40L surface via the FAB domains, with soluble FcR binding.

BMS-986004 bound FcRn with Kd of 670 nM at pH 6.0 which is the relevant pH for binding within the endosome, TABLE 9. However, binding was significantly reduced (Kd>5000 nM) at neutral pH suggesting efficient release of from FcRn under these conditions. BMS-986004 bound CD64 with a Kd of 0.6 nM, and had a statistically weak affinity for CD32a, CD32b/c, CD16a and CD16b (Kd>3000 nM). Both 5c8-IgG1 and 5c8-CT had a similar FcRn affinity as BMS-986004. 5c8-CT, which has the identical "CT" Fc region as BMS-986004, also had a similar FcγR binding properties as BMS-986004, whereas 5c8-IgG1, which has a wild type IgG1 Fc domain, bound more strongly to FcγRs, TABLE 9.

TABLE 9

Fc receptor affinity as determined using SPR (Biacore).

| Sample | pH | BMS-986004 Kd (nM) | 5c8-IgG1 Kd (nM) | 5c8-CT Kd (nM) |
|---|---|---|---|---|
| hFcRn | 6 | 670 | 590 | 720 |
| hFcRn | 7.1 | >5000 | >5000 | >5000 |
| CD64 | 7.1 | 0.6 | <0.05 | 0.9 ± 0.4 |
| CD32a | 7.1 | >3000 | ~$10^{-7}$ M* | >3000 |
| CD32b/c | 7.1 | >3000 | >3000 | >3000 |
| CD16a | 7.1 | >3000 | 240 ± 40 | >3000 |
| CD16b | 7.1 | >3000 | >3000 | >3000 |

*CD32a binding to 5c8-IgG1 was biphasic. Kd was estimated as ~$10^{-7}$ M based on steady state fit to dominant binding even. This Kd is in range of literature reported KD for CD32a binding to IgG1.

Example 6

In-vitro Cell-based Assays

The potency of BMS-986004 was evaluated in various primary immune cell assays to ensure robust potency across different cell types. The primary human B cell proliferation assays were conducted two ways, as described in detail above in Example 4: (1) recombinant CD40L trimer was used to drive B cell proliferation; and (2) CHO cells expressing CD40L on the membrane (CHO-CD40L) were utilized to induce B cell proliferation. The utility of CHO-CD40L cells was particularly important to ensure that signals from membrane-bound CD40L were inhibited equally well when compared to the soluble CD40L trimer. The CHO-CD40L cells were also used to drive the activation of primary human DCs differentiated from culturing PBMC-derived monocytes in presence of GM-CSF and IL-4. Similarly, the T-B MLR assay measured B cell activation driven by CD40L present on activated T cells. In all of the above described primary assays, BMS-986004 was equipotent to the benchmark 5c8 mAb: potencies ranged from was single-digit nM to sub-nM, depending on the assay (TABLE 10).

TABLE 10

Potency of BMS-986004 in Various Primary Cell Assays

| mAb/dAb-Fc | Trimer B cell Assay EC50 (nM) | CHO-CD40L B Cell Assay EC50 (nM) | T-B MLR EC50 (nM) | T-B MLR IL-6 EC50 (nM) | CHO-CD40L DC Assay IL-12 EC50 (nM) | CHO-CD40L DC Assay IL-6 EC50 (nM) | CHO-CD40L DC Assay TNF-a EC50 (nM) |
|---|---|---|---|---|---|---|---|
| 5c8 | 8.0 ± 3.0 | 2.0 ± 2.0 | 0.54 ± 0.37 | 0.23 ± 0.09 | 2.0 ± 1.5 | | |
| 5c8-IgG1 | 5.0 ± 1.0 | 2.0 ± 2.0 | 0.34 ± 0.13 | 0.21 ± 0.06 | 0.92 ± 0.94 | 0.73 ± 0.5 | 2.3 ± 1.3 |
| BMS-986004 | 5.0 ± 0.5 | 1.0 ± 0.5 | 0.16 ± 0.05 | 0.13 ± 0.04 | 3.1 ± 1.6 | 1.9 ± 0.6 | 3.6 ± 1.1 |

Example 7

Assessment of Whole Blood Receptor Occupancy (RO)

A receptor occupancy method was developed to measure CD40L target engagement by BMS-986003 in cynomolgus whole blood samples and, subsequently, in BMS-986004 in human whole blood samples. BMS-986003 is a dAb which shares the same amino acid sequence as BMS-986004, except for a non-native glycine residue at its amino-terminus.

Occupancy is measured on CD4+ T cells by flow cytometry using an anti-CD40L mAb that competes for binding to CD40L with BMS-986003/BMS-986004, and is cross-reactive with human and cynomolgus CD40L. In the presence of bound dAb, the anti-CD40L detection mAb is blocked from binding to CD40L in a concentration-dependent manner, providing a measure of target occupancy. Given that basal CD40L is expressed at low levels on resting T cells in peripheral blood, RO was assessed in both unstimulated blood samples and in samples where phytohemagglutinin (PHA) was used to induce up-regulation of CD40L on the T cell surface. Binding potency curves were generated following ex vivo whole blood treatment with BMS-986003 and BMS-986004. The average $EC_{50}$ and $EC_{90}$ values obtained are shown in TABLE 11.

TABLE 11

Binding Potency of BMS-986003 and BMS-986004 on CD4+ T-cells in ex vivo Whole Blood Receptor Occupancy Assay

|  | n | Average $EC_{50}$, nM | Average $EC_{90}$, nM |
|---|---|---|---|
| BMS-986003 |  |  |  |
| Human (basal) | 1 | 0.9 | 3 |
| Human (PHA-induced) | 6 | 0.8 | 9 |
| Cyno (basal) | 3 | 0.6 | 3 |
| Cyno (PHA-induced) | 3 | 0.4 | 2 |
| BMS-986004 |  |  |  |
| Human (basal) | 3 | 0.4 | 3 |
| Human (PHA-induced) | 3 | 0.7 | 5 |

The target binding potency in whole blood for BMS-986003 and BMS-986004 closely correlates between human and cynomolgus monkey. The $EC_{50}$ values for BMS-986003 and BMS-986004 are also similar when bound to basal and PHA-induced CD40L. Additionally, these values are comparable to those obtained in human in vitro cell based assays (see TABLE 10). Based on the measured $EC_{90}$ values, full target saturation in peripheral blood should be achieved at concentrations ≤10 nM.

To support the preclinical PK/PD profile of BMS-986003 and BMS-986004, RO was assessed in both the cynomolgus KLH study (immunization with keyhole limpet hemocyanin) with BMS-986003 and the IV bridging study with BMS-986004. Further details of these findings can be found in Examples below.

Example 8

In Vivo Pharmacology

To show efficacy of a CD40L dAb in mouse disease models, a mouse CD40L dAb 2m126-24 was formatted with mouse IgG1 Fc with D265A point mutation to further lower the Fc effector function. This mouse surrogate dAb 2m126-24-Fc shows potency comparable to BMS-986004 and MR-1, a hamster anti-mouse CD40L antibody (TABLE 12).

TABLE 12

In vitro Potency Comparison

|  | mAb/dAb-F | Trimer B cell Assay $EC50(nM)$ | CHO-CD40L B cell Assay $EC50(nM)$ | CHO-CD40L DC Assay IL-6 $EC50(nM)$ |
|---|---|---|---|---|
| Human | 5c8 | 8.0 ± 3.0 | 2.0 ± 2.0 |  |
|  | BM5-986004 | 5.0 ± 0.5 | 1.0 ± 0.5 | 1.9 ± 0.6 |
| Mouse | 2m126-24-FC | 4.7 ± 0.9 | 0.4 ± 0.06 | 0.5 ± 0.2 |
|  | MR-1 (mAb) | 1.7 ± 0.4 | 0.6 ± 0.2 | 0.6 ± 0.3 |

Inhibition of KLH Induced Antibody Response by the Mouse CD40L dAb

Figure 7:
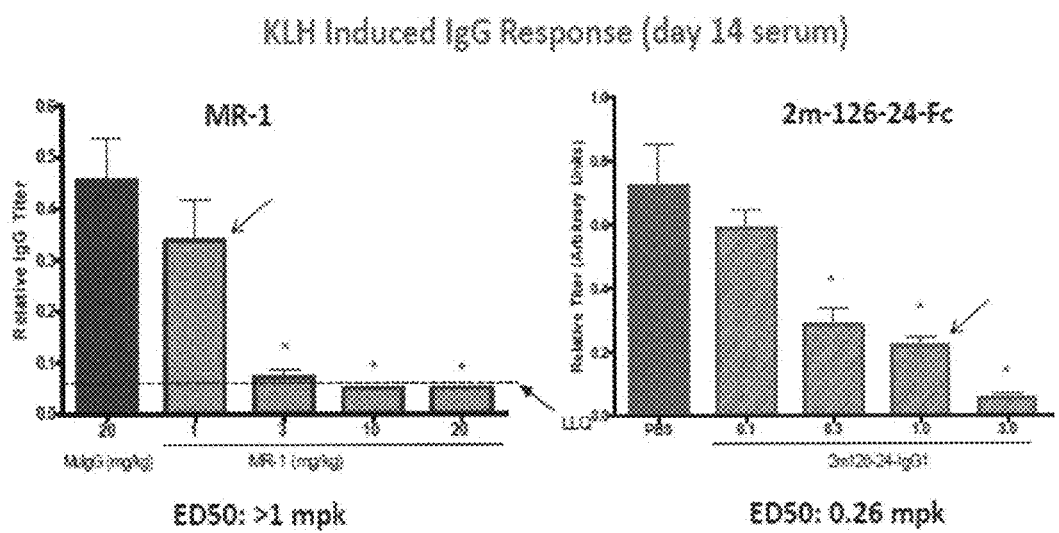
FIG. 7 shows in vivo efficacy of mouse CD40L surrogate dAb-Fc (KLH-induced antibody response.

Female BALB/c mice were injected intraperitoneally (i.p.) with 250 µg KLH on day 0. Mice were dosed subcutaneously (s.c.) with MR-1 or BMS-2m-126-24-Fc at indicated doses on day −1 and day 6. Blood was collected and the serum was analyzed for anti-KLH IgM on day 7 and IgG on day 14 by ELISA. Serum from BALB/c mice collected on day 14 after immunization with KLH was pooled and used as a positive comparator, and the data is expressed as a ratio of the titre of the test serum to the titre of the pooled BALB/c serum. As shown in FIG. 7, BMS-2m-126-24-Fc demonstrated a dose dependent suppression of IgG titers with maximal effect shown at 3 mg/kg, with ED50 calculated to be 0.26 mg/kg. Both the CD40L dAb and the antibody were tested at 1 mg/kg, showing 70% vs. 30% reduction in IgG response, respectively. Similar exposure of the dAb and the antibody were observed at 1 mg/kg, suggesting that the dAb is slightly more potent than the antibody at suppressing KLH-induced IgG response. In conclusion, the CD40L dAb has demonstrated at least the same level of efficacy as the anti-CD40L antibody at inhibiting a T cell dependent antibody response.

Inhibition of TNBS-induced Colitis by the Mouse CD40L dAb

Figure 8:
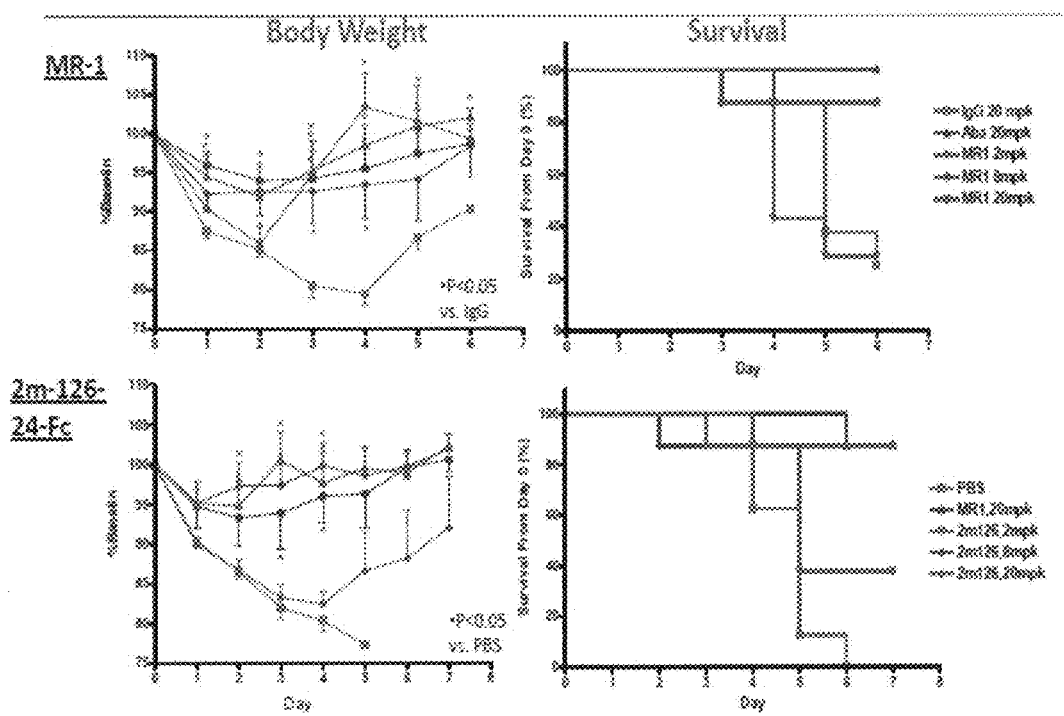
FIG. 8 demonstrates that mouse dAb BMS-2m-126-24-Fc and antibody MR-1 inhibit TNBS-induced colitis in mice.

Male SJL/J mice were intrarectally administered with 2.5 mg Trinitrobenzene sulfonic acid (TNBS) in 50% EtOH via a catheter inserted 4 cm distal to the anus. Mice were dosed once s.c. with MR-1 or BMS-2m-126-24-Fc at indicated doses 4 hours prior to TNBS injection. FIG. 8 presents the changes in the mean body weight and the percent survival of groups of mice treated with PBS/IgG or varying dose levels of MR-1 or the dAb. Abatacept was used as a positive control (20 mg/kg, i.p. every other day). A typical profile of TNBS-induced colitis was shown in the IgG control group: loss of body weight, peaking at day 3-4; colitis-related death occurring at day 3 and beyond; and the survived mice showing signs of recovery after day 4. Treatment with the CD40L dAb or the antibody (both tested at 2, 8 and 20 mg/kg) caused a dose-dependent inhibition of the body-weight loss and the increase in survival rate; both compounds at 8 mg/kg yielded a degree of efficacy that is comparable to that of Abatacept at 20 mg/kg. In conclusion, the mouse CD40L dAb BMS-2m-126-24-Fc has demonstrated comparable efficacy to the anti-CD40L antibody MR-1 in an acute TNBS-induced colitis model.

Figure 9:
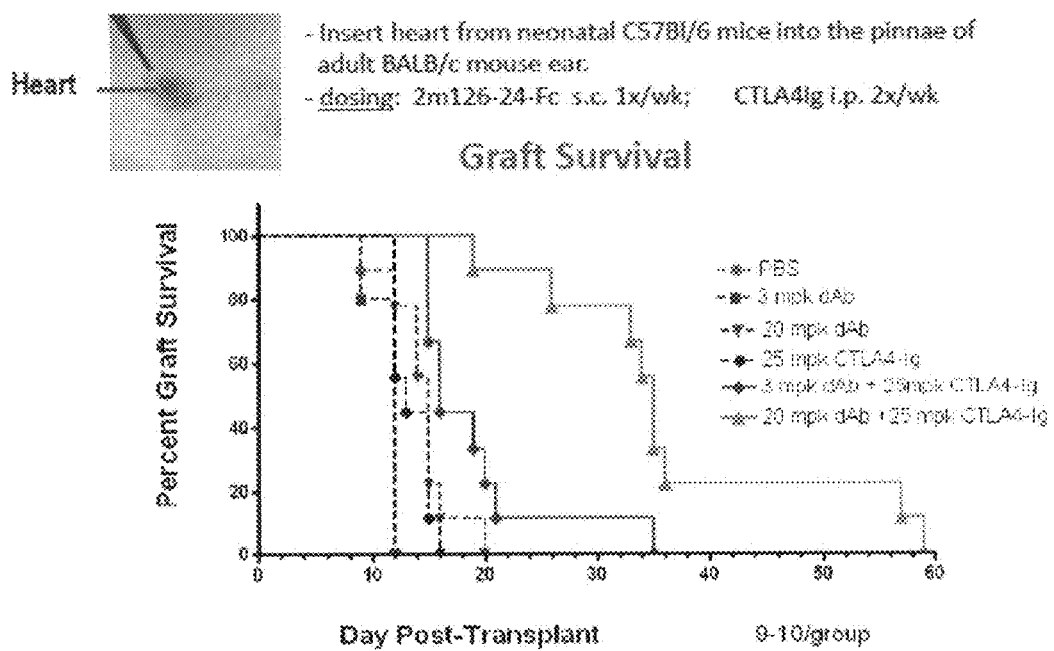
FIG. 9 shows that BMS-2m-126-24-Fc and CTLA4-Ig work synergistically to prolong the survival of cardiac allografts.

Synergistic Effect Between CTLA4 Ig and the Mouse CD40L dAb in a Mouse "Heart-to-Ear" Transplant Model Heart grafts from neonatal (48-72 hrs) C57B1/6 mice were implanted into a subcutaneous pocket created in the ear pinnae of BALB/c mice. Mice were treated with CTLA4-Ig (i.p. 2×/wk), BMS-2 m126-24-Fc (s.c. 1×/wk), or combination of both at indicated doses, with first dosing initiated the day prior to transplantation. Time to rejection was defined by the absence of cardiac contractility for three consecutive days as assessed daily by the electrocardiogram (ECG) device of allograft. As expected, without any treatment, C57BL/6 mice that received the neonatal BALB/c heart rejected the graft shortly thereafter, with median survival time (MST) of 12 days. The monotherapy with 3, 20 mg/kg of the dAb or 25 mg/kg of CTLA4-Ig had no or little impact on prolonging the survival of the allograft (MST: 12, 15 and 13 days respectively). However, in the groups treated with combination of 20 mg/kg of the dAb and 25 mg/kg of CTLA4-Ig, the graft survival was significantly prolonged showing MST of 35 days (FIG. 9). This data has provided rationale for combining CD40L dAb with belatacept in human renal transplant patients. Future transplant studies in non-human primates will further define the dose level and assess the potential effect on tolerance induction with CD40L dAb BMS-986004.

Example 9

In Vivo Nonclinical Pharmacokinetics (PK) and Pharmacodynamics (PD)

Various in vivo studies were conducted to characterize the PK and PD of BMS-986004, BMS-986003, and a mouse CD40L dAb-Fc surrogate BMS-2m-126-24-CT, in the nonclinical setting. The key findings are summarized below.

ELISA to Measure BMS-986004 dAb

Enzyme-linked immunosorbency assay (ELISA)-based bioanalytical methods were developed to support the PK studies, acute and chronic efficacy studies in mice, and exploratory PKJPD studies employing cynomolgus monkeys. In all cases, whole blood was obtained and plasma prepared in the presence of EDTA, the samples were then subjected to ELISA analysis.

Plasma concentrations of BMS-986004 were measured with an ELISA assay that utilized human CD40L antigen to capture the analyte from test samples. Test samples were thawed at 4° C., mixed well and diluted 1:100 in assay diluent composed of 1×PBS, 0.05% Tween-20, and 1% BSA (PTB). Subsequent dilutions of the sample were made using 1% normal monkey plasma/PTB as diluent. This allowed the test analyte to be assayed at several dilutions ($10^2$-$10^5$) while keeping the sample matrix at 1%.

Recombinant trimeric human CD40L was obtained from Protein Structure and Science (PSS), LVL and was bound to 96 well plates at a final concentration of 2 µg/mL. Test samples, quality control (QC) samples and the standards were detected with affinity-purified rabbit anti-heavy chain (Vh) domain framework polyclonal antibody (Covance Research Products, Denver, Pa.) diluted to a concentration of 0.25 µg/ml in PTB, followed by horseradish peroxidase-labeled donkey anti-rabbit polyclonal secondary antibody (Jackson Immunoresearch, West Grove, Pa.) with substrate (TMB—tetramethylbenzidine) added, and the enzymatic reaction stopped with 1 M phosphoric acid. Absorbance was measured at a wavelength of 450 nm. The analysis of BMS-986004 in test samples was conducted using a standard curve. Standard curve calibrators prepared on the day of each run in 1% monkey plasma were used to define the dynamic range of the bioanalytical method. The range of resulting standard curve in 100% plasma was 10-1200 ng/mL. The reference standard for BMS-986004 was obtained from Biologics Process and Product Development (BPPD), HPW. The reference standard material was representative of the manufacturing batch and was used in the study protocol. Standard curves and QCs were evaluated using criteria for accuracy and precision of ≤20% which was considered to be acceptable for assay performance. Test samples were quantified using a 4-parameter logistic fit regression model weighted by reciprocal concentration (1/x) derived from the calibrators.

Performance of the QC samples, measured by the deviation of the calculated concentration from its nominal value indicated the reference material was stable in neat monkey plasma at concentrations of 30-1000 ng/ml when stored at −70° C. for over 2 months.

ELISA to Measure a Mouse Surrogate dAb

Mouse CD40L-specific dAb BMS-2m-126-24-CT was measured in mouse plasma samples to provide exposure data in support of several acute and chronic efficacy studies as well as PK assessment.

While the assay format for mouse dAbs was quite similar to that for human dAbs in monkey samples, there were a few differences. The mouse plasma matrix was diluted to 1:10 (10%) in assay diluent, and all subsequent dilutions of test samples were made using 10% mouse matrix. Likewise, all standards and QCs were also incubated on ELISA plates in 10% mouse plasma. The concentration of BMS-2m-126-24-CT in test samples from mice was measured using mouse CD40L to capture the analyte. As the mouse dAb has Vk framework, all test samples, QCs, and the standards were detected with affinity purified rabbit anti-kappa (Vk) domain polyclonal antibody (Covance Research Products, Denver, Pa.) diluted to a concentration of 0.5 µg/mL in PTB. The rest of the assay and analysis procedure was similar to the procedure for the analysis of human CD40L dAbs. Acceptance criteria for back-calculated concentrations of standards and QCs were also similar to those for human CD40L dAbs. The quantitative range of BMS-2m-126-24-CT as determined from the standard curve was 12.5 to 600 ng/mL in neat sample matrix.

Nonclinical Pharmacokinetics

TABLE 13 summarizes the PK parameters for BMS-986004, BMS-986003, and BMS-2m-126-24-CT in nonclinical animal species.

TABLE 13

Single-dose PK Parameters (mean ± SD) from Two Nonclinical Animal Species

| Species | dAb | Route | Dose (mg/kg) | Cmax (μM) | Tmax (h) | AUC0-inf (μM · h) | T½ (h) | CLTp (mL/h/kg) | Vss (L/kg) | F (%) |
|---|---|---|---|---|---|---|---|---|---|---|
| Mouse | BMS-2m-126-24-CT | IV | 1 (N = 3) | — | — | 6.9 | 101 | 1.85 | 0.26 | — |
| | | SC | 1 (N = 3) | 0.063 | 24 | 10 | 100 | — | — | 100 |
| | | | 10 (N = 3) | 0.68 | 24 | 114 | 120 | — | — | 100 |
| Monkey | BMS-986003 | IV | 2 (N = 2) | — | — | 40 | 106 | 0.67 | 0.067 | — |
| | | SC | 0.2 (N = 4) | 0.019 ± 0.004 | 60 ± 72 | 4.0 ± 2.7 | 85 ± 29 | — | — | 88 |
| | | | 2 (N = 4) | 0.22 ± 0.075 | 33 ± 43 | 29.7 ± 4.9 | 68 ± 11 | — | — | 74 |
| | | | 20 (N = 4) | 1.48 ± 0.34 | 11 ± 9 | 175 ± 27 | 105 ± 18 | — | — | 44 |
| | BMS-986004 | IV | 11 (N = 4) | — | — | 241 ± 18 | 124 ± 12 | 0.59 ± 0.04 | 0.098 ± 0.01 | — |
| | 5c8-IgG1 | IV | 20 (N = 4) | — | — | 1800 ± 74 | 400 | 0.074 | 0.042 | |

Figure 11A:
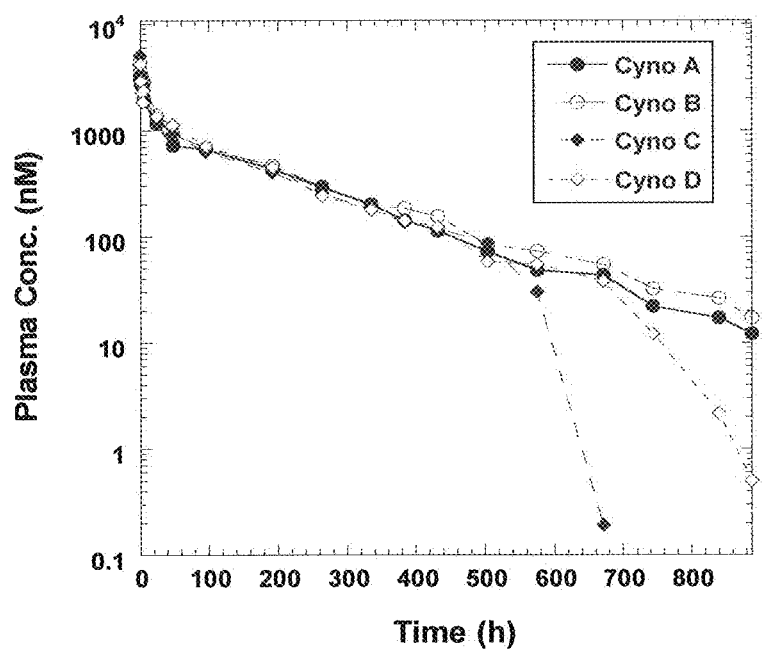
FIG. 11A shows plasma concentration vs. time profile of BMS-986004 after IV dosing of 11 mg/kg in monkeys.
Figure 11B:
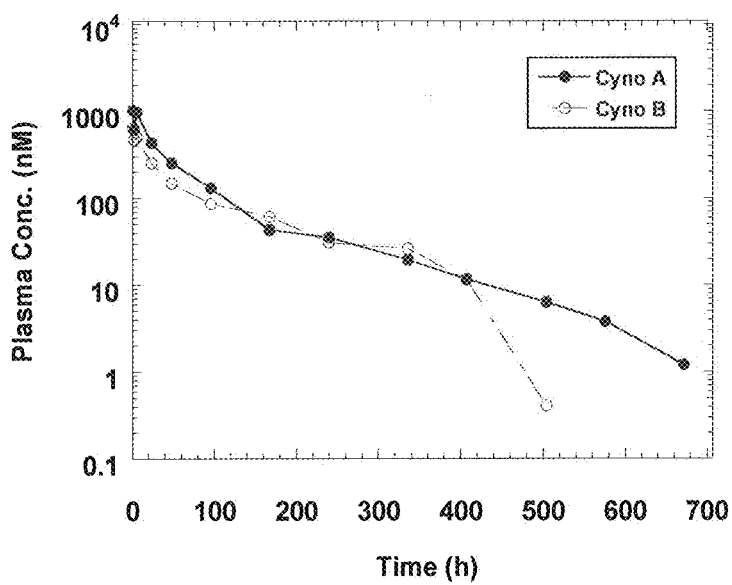
FIG. 11B demonstrates plasma concentration vs. time profiles of BMS-986003 after IV dosing of 2 mg/kg in monkeys.

BMS-986004 and BMS-986003 exhibited comparable PK profiles in monkeys (FIG. 11A and FIG. 11B). After IV administration, the plasma concentrations of BMS-986004 and BMS-986003 exhibited a bi-exponential decline up to 504 and 408 h, respectively. Accelerated clearance was observed afterward in 50% of monkeys enrolled in both studies. Immunogenicity testing of the plasma samples collected at 38 d after BMS-986004 treatment suggested that all monkeys developed anti-drug antibody (ADA); and that the monkeys with higher ADA levels showed faster clearance. Although no immunogenicity test was conducted for the IV PK study with BMS-986003, a similar level of immunogenicity was observed in monkeys after subcutaneous dosing with BMS-986003 in the PK/PD study, suggesting both proteins were immunogenic in monkeys. The terminal half-life (T1/2) of 124 and 106 h for BMS-986004 and BMS-986003 was, therefore, determined using the exposures collected up to two weeks (336 h) only. The steady-state volume of distribution (Vss) of BMS-986004 and BMS-986003 was 0.098 and 0.074 L/kg, respectively. The values are greater than the plasma volume (0.06 L/kg) but less than the volume of extracellular fluid (0.2 L/kg), suggesting that the proteins largely reside in the extracellular space. The total body plasma clearance (CLTp) of BMS-986004 and BMS-986003 was 0.59 and 0.65 mL/h/kg, respectively.

The PK parameters of BMS-986004 in monkeys were compared to those of abatacept, a similar size protein (78.5 vs 78-kDa BMS-986004, based on amino acid sequence), with the same modified human IgG1 Fc format. As expected, the parameters of BMS-986004 were nearly identical with those of abatacept (CLTp of 0.6 mL/h/kg, Vss of 0.087 L/kg, T1/2 of 5 d), suggesting the humans PK of BMS-986004 and abatacept is likely to be similar.

Figure 12:
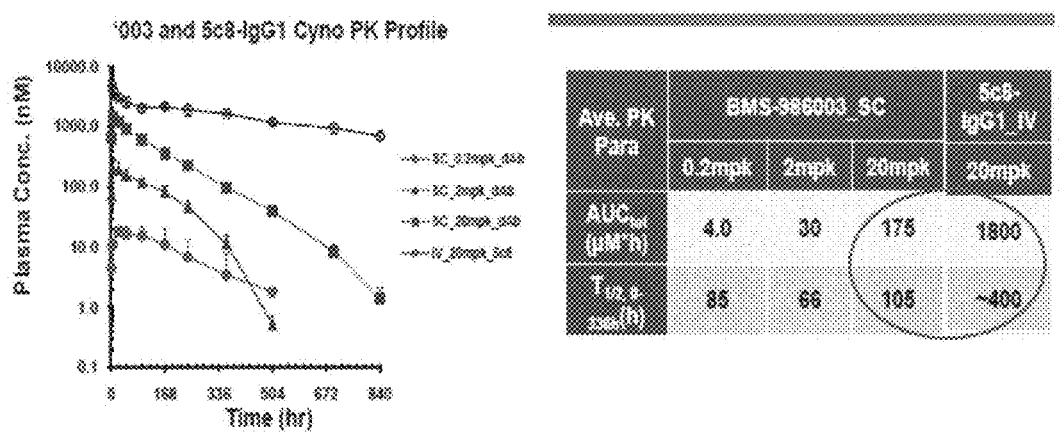
FIG. 12 presents plasma concentrations vs. time profiles of BMS-986003 (after SC dosing at 0.2, 2 and 20 mg/kg in monkeys) and of 5c8 IgG1 (after IV dosing at 20 mg/kg in monkeys).

The absorption of BMS-986003 after subcutaneous (SC) administration was evaluated in the monkey PK/PD study. The monkeys were administered with BMS-986003 as single subcutaneous doses of 0 (vehicle control), 0.2, 2 and 20 mg/kg, at 24 h prior to the immunization with keyhole limpet hemocyanin (KLH), a T cell-dependent antigen. After dosing, BMS-986003 was slowly absorbed, with a Tmax ranging from 6-96 h (FIG. 12). The exposure of BMS-986003 appeared to be less than dose-proportional across all dose levels. With a dose ratio of 1:10:100, the average Cmax and AUC0-inf ratios were 1:12:80 and 1:7:44, respectively. With the exposure following the IV dose (2 mg/kg) as reference, and assuming linear PK after IV dosing, the SC bioavailability of BMS-986003 was 88%, 74%, and 44% at 0.2, 2, and 20 mg/kg, respectively. The terminal T1/2 was confounded by the immunogenicity observed with most of the monkeys at 2 to 5 weeks after dosing. Therefore, the T1/2 was estimated to be 85, 66, and 105 h at 0.2, 2 and 20 mg/kg, respectively.

The PK of 5c8-IgG1, an anti-human CD40L monoclonal antibody used as a positive control in the PK/PD study, was evaluated after IV administration at 20 mg/kg (FIG. 12). 5c8-IgG1 exhibited 10-fold higher plasma exposures and 4-fold longer T1/2 when compared to BMS-986003 given SC at the same dose (TABLE 13).

Figure 13:
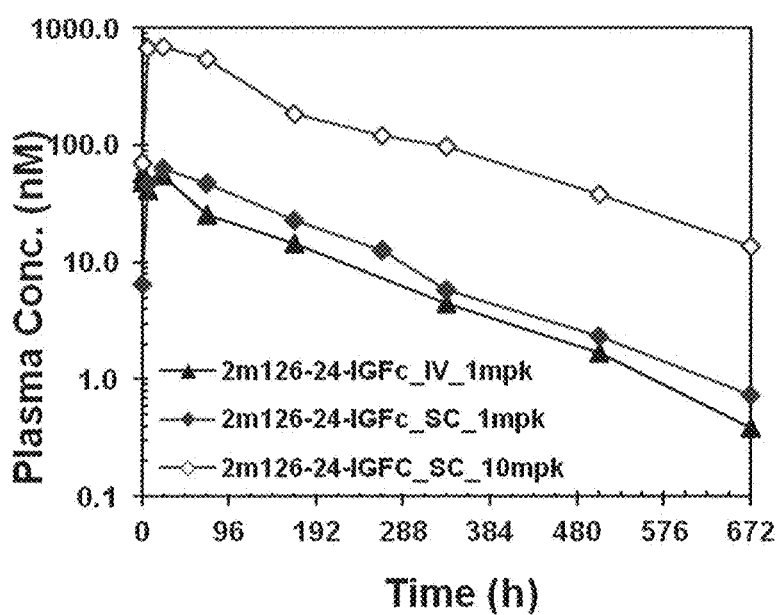
FIG. 13 shows plasma concentrations vs. time profiles of BMS-2m-126-24-CT after 1 mg/kg IV and SC dosing, and 10 mg/kg SC dosing to mice.

The PK of the mouse surrogate dAb-Fc fusion protein, BMS-2m-126-24-CT, was evaluated in mice following single IV and SC administration (TABLE 13). After a single IV (1 mg/kg), the plasma concentrations followed a mono-exponential decline with a terminal T1/2 of 101 h (FIG. 13). The CLTp was 1.85 mL/h/kg; and the Vss was at 0.26 L/kg, indicating extracellular distribution. After single SC doses of 1 and 10 mg/kg, BMS-2m-126-24-CT was slowly absorbed with a Tmax of 24 h. The systemic exposures increased in a dose-proportional manner. With a dose ratio of 1:10, the Cmax and AUC0-inf increased in the proportion of 1:11. The terminal T1/2 was 100 and 120 h at 1 and 10 mg/kg, respectively. The ratio of the dose-adjusted exposure (AUC0-inf) after SC and IV administration was greater than 1, suggesting complete absorption after SC administration.

Pharmacokinetic/Pharmacodynamic Modeling

The PD of BMS-986003 was measured as the suppression of anti-KLH antibody response in the PK/PD study. BMS-986003 suppressed 70% the antibody response to KLH $$\left(\% \text{ response suppressed} = \left(1 - \frac{AUEC_{0-1008h\ IgG\ titers} \text{treated group}}{AUEC_{0-1008h\ IgG\ titers} \text{vehicle group}}\right) * 100\right)$$

at the highest dose of 20 mg/kg. Marginal (15%) and no suppression of the antibody response occurred at 2 and 0.2 mg/kg. In comparison, 5c8-IgG1 exhibited 10-fold higher plasma exposures and 4-fold longer T1/2 than BMS-986003 at the same dose level (20 mg/kg). As a result, 5c8-IgG1 suppressed 97% anti-KLH antibody response. In order to compare the in vivo potency between BMS-986003 and 5c8-IgG1, PK/PD modeling was performed using SAAM II (version 1.2.1, Seattle, Wash.). The plasma concentrations of BMS-986003 following SC administration were described using a first-order absorption kinetics coupled with a 2-compartment model, where the elimination occurred in both central and peripheral compartments. Because of complications from immunogenicity and possible nonlinear absorption, the PK data were fitted individually at each dose.

For 5c8-IgG1, a two-compartment model with central elimination was used. The anti-KLH antibody response, expressed as the average value of IgG titers, was modeled using a 6-compartment signal transduction model. The kinetics of KLH in the body was assumed to be a 1-compartment model. The inhibition of the IgG production by BMS-986003 and 5c8-IgG1 was described using an Imax model, with a maximum inhibition equal to 100%. As shown in FIG. 14, the model-fitted curves were able to describe both the PK and PD profile. The plasma IC50 of BMS-986003 and 5c8-IgG1 for the suppression of KLH-induced IgG production was estimated to be 74±14 and 60±18 nM, respectively. These results demonstrated that the potency of these two molecules was comparable in vivo.

The CD40L receptor occupancy (RO) of BMS-986004 was measured in the IV PK study. Following IV administration of 11 mg/kg, the RO of BMS-986004 on the peripheral-blood mononuclear cells (PBMC) was time- and concentration-dependent. PK/PD modeling was performed to estimated an RO EC50. The plasma concentrations were modeled using a modified two-compartment model with an additional ADA-mediated first order elimination constant introduced at 504 h after dosing; and the RO was modeled using an Emax model $$RO\% = \frac{E\max * Cp^\gamma}{EC50^\gamma + Cp^\gamma}.$$

Figure 15:
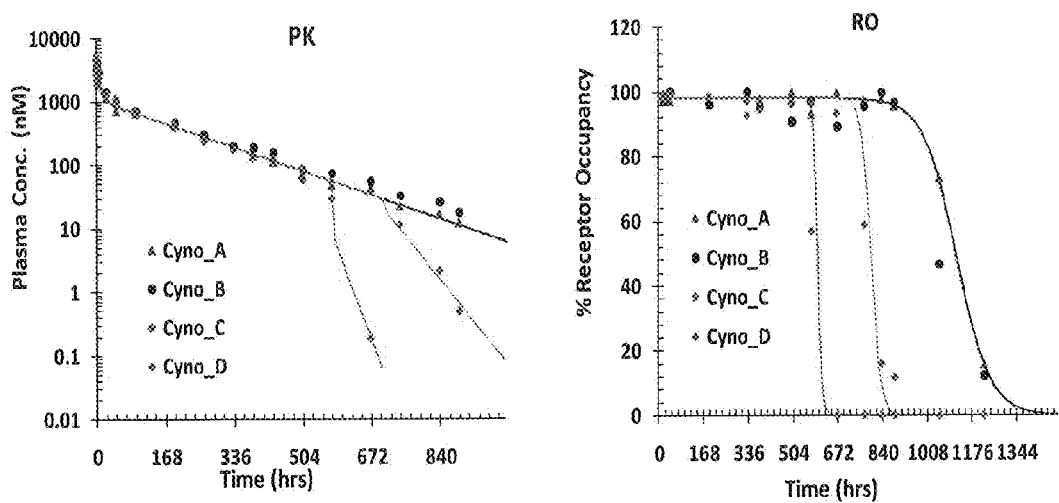
FIG. 15 shows PK/PD modeling of BMS-986004 plasma exposures and ex vivo RO on peripheral blood mononuclear cells (PBMC).

As shown in FIG. 15, the fitted curves were able to describe both exposure and RO, with an estimated RO EC50 of 3.4±0.3 nM and the γ (hill factor) of 3.1±0.1. In comparison, the RO EC50 was ~22-fold lower than the anti-KLH antibody response IC50 of 74±14 nM, suggesting that >95% RO is required in order to achieve appreciable (>50%) anti-KLH antibody suppression.

Example 10

Nonclinical Toxicology Single-dose PK/PD Study

The objectives of this study were to 1) determine the tolerability of BMS-986003, including its potential immunogenicity, when given subcutaneously as a single dose to monkeys; 2) evaluate its PD (e.g., inhibition of the antibody response to T-cell-dependent antigen) and PK profiles; 3) evaluate the receptor occupancy of BMS-986003 and peripheral T-cell counts following subcutaneous dosing; and 4) aid dose selection for renal transplant studies and first-in-human dosing.

BMS-986003 was administered s.c. in the posterior thorax as single doses of 0 (vehicle control), 0.2, 2, or 20 mg/kg to groups of 2 cynomolgus monkeys per sex. An additional two monkeys/sex received a single intravenous dose of 20 mg/kg 5c8-IgG1, a monoclonal antibody to human CD40L that was used as a positive control in this study. All doses were administered at 2 mL/kg in the vehicle (PBS; pH 7.2). To assess the effects on the T-cell dependent antibody response, animals were immunized at approximately 24 hours after dosing with test article or immediately after dosing the positive control with 10 mg of KLH by intramuscular injection (posterior quadriceps or caudal thigh). Criteria for evaluation included survival, PK, immunogenicity, PD (inhibition of the antibody response to the T-cell-dependent antigen, KLH), clinical signs, body weights, food consumption, peripheral-blood immunophenotyping, receptor occupancy, and clinical-pathology evaluations (hematology, serum chemistry, and coagulation). Animals were returned to stock following a 6-week post-dose observation period.

At doses ≤20 mg/kg, BMS-986003 was slowly absorbed (Tmax=6-96 h) and $C_{max}$ and AUCtot values increased in a less than dose-proportional manner across all dose groups and there were no apparent gender differences. The T1/2 values estimated ranged from 69-104 h across all doses. BMS-986003 was substantially immunogenic; all monkeys developed a positive anti-drug antibody (ADA) response during the 6-week post-dose period. At 0.2 and 2 mg/kg, the mean group total ADA response peaked at Day 22 at mean group end point titers (EPT) of 4203 and 6469, respectively. At 20 mg/kg, the ADA response, while positive, was somewhat delayed and partially suppressed, consistent with target pharmacology, peaking at Day 36 at a mean group EPT of 1828. Further characterization of the antibodies demonstrated the majority of binding to the dAb (non-Fc) portion of the molecule and these antibodies were shown to block the binding of BMS-986003 to CD40L in 2 different immunoassay formats suggesting that the ADA were neutralizing. In addition, the formation of ADA appeared to accelerate the elimination of BMS-986003 in several monkeys.

Mean PK parameters for BMS-986003 are presented in TABLE 14.

TABLE 14

Pharmacokinetic Summary

| Mean Parameter Gender | BMS-986003 SC | | | 5C8-IgG1 IV |
|---|---|---|---|---|
| | 0.2 mg/kg (N = 4) Male/Female | 2 mg/kg (N = 4) Male/Female | 20 mg/kg (N = 4) Male/Female | 20 mg/kg (N = 4) Male/Female |
| AUC(0-inf) µg·h/mL | 219/407 | 2165/2477 | 14195/13114 | 267750/272250 |
| CLTp mL/h/kg | Not applicable | Not applicable | Not applicable | ND/0.074 |
| T1/2 h | 69/101 | 68/69 | 107/104 | ND/400 |
| Cmax µg/mL | 69/101 | 45/49 | 88/91 | Not applicable |
| Tmax h | 24/96 | 51/15 | 6/15 | Not applicable |

Molecular weight used for conversion was 78104 Da for BMS-986003, 150000 Da for 5c8-IgG1 mAb. ND = not determined,; AUC extra for males was above 20%, therefore the T1/2 was not reported.

There were no BMS-986003- or 5c8-IgG1-related clinical observations or effects on body weights or clinical pathology parameters except 1 male treated with 5c8-IgG1 had decreased red blood cells (0.74× control), hemoglobin (0.73× predose), and hematocrit (0.75× predose) on Day 8, and 3 of 4 monkeys receiving 5c8-IgG1 had decreased lymphocytes (0.53× to 0.65× predose) on Day 8, suggestive of lymphocyte depletion.

CD40L receptor occupancy was generally time- and dose-dependent and more sustained following administration of 20 mg/kg BMS-986003, consistent with higher and more sustained exposures at this dose and PD activity. For BMS-986003, mean peak receptor occupancy on peripheral-blood mononuclear cells (PBMC) was achieved at 24 hrs (97%), 6 hrs (99%) or 48 hrs (99%) post-dose, decreasing to <90% occupancy at 240, 360, or 696 hrs and to <50% occupancy at 360, 696, or 1032 hrs, at 0.2, 2, or 20 mg/kg, respectively. In comparison, for 5c8-IgG1 at 20 mg/kg, mean peak receptor occupancy on PBMC was achieved at 48 hours (≥100%), and was sustained at ≥97% for the entire study (1032 hr or through Day 44).

BMS-986003 suppressed the antibody response to KLH only at the high dose of 20 mg/kg. On Days 8-30 at 20 mg/kg, there was a 69 to 83% suppression of the geometric group mean antibody response to KLH, relative to the control group, with a peak suppression of 83% occurring on Day 16. No suppression of the antibody response occurred at 0.2 or 2 mg/kg BMS-986003. These data demonstrate that BMS-986003 at a sustained receptor occupancy of >90% for at least 1 month and at sustained plasma concentrations above ~10 μg/mL through Day 11 is able to inhibit a T-cell dependent antibody response in cynomolgus monkeys. For the positive control antibody, 5c8-IgG1, suppression of 74-97% of the geometric group mean antibody response to KLH occurred on Days 8-30, with peak suppression of 97% by Day 16 which was generally sustained through Day 30.

No biologically relevant BMS-986003 related changes in absolute numbers of B cells (CD45+, CD20+, CD3−), total T (CD45+, CD3+) cells, helper T (CD45+, CD3+, CD4+, CD8−) cells, cytotoxic T (CD45+, CD3+, CD4−, CD8+) cells, or natural killer (CD45+, CD3−, CD16+) cells occurred during the study, which confirmed lack of any Fc effector function. However, on Day 8, 3 of 4 monkeys treated with 20 mg/kg 5c8-IgG1 had decreased T-lymphocytes (0.53×-0.66× predose), both helper T-cell (0.64× to 0.77× predose) and cytotoxic (0.40× to 0.61× predose) T-cell populations, suggestive of depletion.

In conclusion, BMS-986003 administered as single SC doses of 0.2, 2, or 20 mg/kg (AUC≤14195 μg*hr/mL) was well tolerated in cynomolgus monkeys with no adverse drug-related effects. The positive control, 5c8-IgG1, at a dose of 20 mg/kg, resulted in complete, sustained inhibition of the antibody response to KLH and sustained receptor occupancy of nearly 100% through 30 days post-dose. Mild depletion of T-cells was also noted by Day 8 in monkeys receiving 5c8-IgG1 (0.40× to 0.77× predose), which was not observed with BMS-986003. BMS-986003 was able to suppress an antibody response to KLH at 20 mg/kg (peak suppression of 83%) following KLH immunization on Day 1 and had sustained receptor occupancy of ≥90% through Day 22 and ≥50% through Day 29. Similar dampening of the immunogenicity to BMS-986003 occurred at 20 mg/kg. However, lower BMS-986003 doses of 0.2 and 2 mg/kg did not suppress the antibody response to KLH or the anti-drug antibody response. The lack of pharmacology at the lower doses also correlated with decreasing receptor occupancy (i.e., <90% by Day 11 [0.2 mg/kg] or 16 [2 mg/kg]; <50% by Day 16 [0.2 mg/kg] or 30 [2 mg/kg]) and accelerated clearance, presumably due to the formation of ADA. The inhibition of TDAR is consistent with the mechanism of action of this compound and was not considered adverse.

Example 11

Evaluation of the Risk for TE/Thrombosis

It has been hypothesized that the TE associated with administration of the anti-CD40L monoclonal antibodies is mediated by anti-CD40L mAb-CD40L immune complex (IC)-mediated cross linking of platelets, facilitated by IC binding to FcgRIIa, an IgG Fc receptor, causing activation and aggregation (FIG. 10). Blocking the interaction of Fc moiety of IgG with FcgRIIa is, therefore, expected to mitigate platelet cross linking and thrombosis. The following methods and approaches were designed to evaluate the risk of TE and/or thrombosis.

In Vitro Platelet Activation Assays

Several in vitro assays were conducted to test the hypothesis that platelets are activated by CD40L mab/sCD40L IC in a FcgRIIa-dependent manner. The positive control 5c8-IgG1 was used to validate the assays prior to testing BMS-986003 and BMS-986004. Blood from human donors or mice expressing hFcgRIIa receptor on platelets were used for these studies. Platelet activation was detected by flow cytometry using antibodies against the well-validated platelet activation markers P-selectin (CD62P) and PAC-1 (activated GPIIb/IIIa). Briefly, blood was diluted 1:25 in modified Tyrodes-HEPES containing 1 mM CaCl2 to which detection antibodies and test reagents was added, incubated, and analyzed for platelet activation. Initial experiments determined that sCD40L or 5c8IgG1 alone did not activate platelets, but different immune complex ratios of 1:1 to 1:8 of 5c8:sCD40L significantly activated platelets. Subsequent experiments used 5c8-IgG1 or 5c8-mIgG2a IC, mostly at a 1:3 molar ratio of 5c8:sCD40L.

Platelet Activation by 5c8/sCD40L IC can be Blocked by Anti-FcgRIIa Antibody

Figure 16:
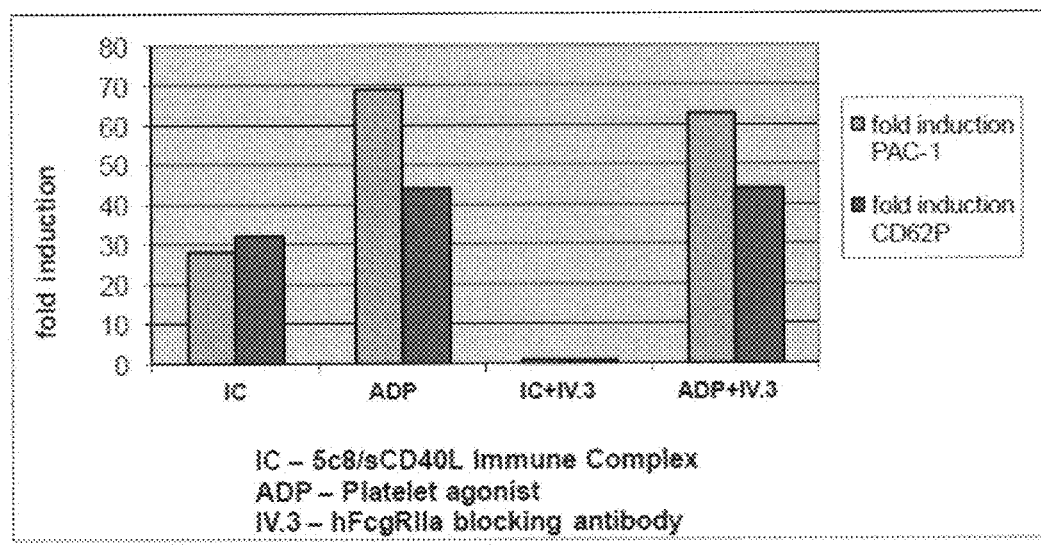
FIG. 16 demonstrates that IV.3 blocks 5c8/sCD40L IC-mediated activation of platelets in human blood.

Studies were conducted with the FcgRIIa blocking antibody IV.3 to test whether activation of platelets by 5c8/sCD40L IC was indeed FcgRIIA-mediated. Blood from human donors was pre-incubated with 0.5 μg/μl of the FcgRIIa blocking antibody IV.3 prior to dilution and incubation with detection antibodies as described above. Adenosine diphosphate (ADP), a platelet activator via a different mechanism, was used as a positive control. As illustrated in FIG. 16, platelet activation by 5c8/sCD40° C. was completely blocked by IV.3, while activation by ADP was not inhibited by the blocking antibody, indicating that activation by the IC is FcgRIIa-mediated.

Selection of Inert Fc Tails

Figure 17:
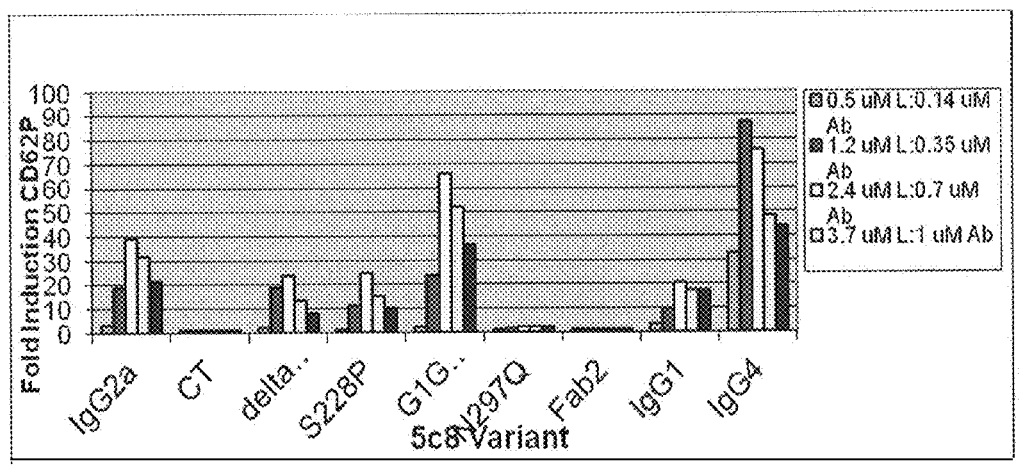
FIG. 17 shows the effect of Fc variants on platelet activation in human blood.

A requirement for potential candidate molecules was absence of binding to FcgRIIa to prevent potential platelet activation. Several 5c8 constructs containing different mutations derived from IgG1 (e.g 5c8-CT and N297Q) or IgG4 (e.g., 5c8-S228P) were expressed and screened for Fc tails that did not activate platelets using different molar ratios of sCD40L to mAbs. Wild-type and most mutated constructs activated platelets except for 5c8-CT and 5c8-N297Q (FIG. 17). Absence of Fc (5c8-Fab2) also did not activate platelets further confirming that IC-platelet activation is Fc-mediated. The CT tail was chosen to format the dAb candidates BMS-986003 and BMS-986004.

Effect of FcgRIIa Polymorphism on Platelet Activation

Figure 18:
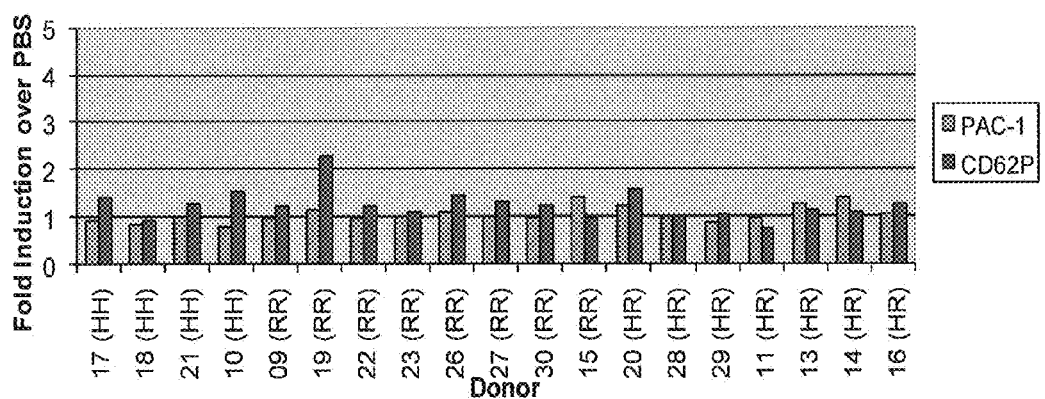
FIG. 18 demonstrates activation of platelets with 5c8-CT/sCD40L IC in blood from human donors genotyped for FcgRIIa polymorphism.

The gene for FcgRIIa is variable at codon 131, resulting in His-Arg (CAT/CGT) polymorphism. The genotype distribution in approximately 100 individuals with about equal distribution of Caucasians and African Americans was A/A (His homozygous; 14%), A/G (His/Arg heterozygous; 60%), and G/G (Arginine homozygous; 26%) for Caucasian Americans and A/A (30%), A/G (51%), and G/G (19%) for African-Americans. Reilly et al., *Clin. Diagn. Lab. Immunol.* 1: 640-644 (1994). Fc-dependent platelet aggregation was noted in samples from R131 individuals when treated with anti-CD9 in mIgG2 or mIgG1 Fc format, while platelets from H 131 individuals aggregated only with anti-CD9 as mIgG2 format; this suggests that Fc-dependent aggregation with an IgG1 mAb could potentially segregate a patient population into low and high responders, which has previously been reported with this polymorphism. Tomiyama et al., *Blood* 80: 2261-2268 (1992). To address any potential differences in platelet activation with the IgG1 and CT Fc tail, 19 donors were genotyped for hFcgRIIa polymorphism and samples tested for platelet activation. The donor pool polymorphism (RR; 42%, HH; 21%, HR; 37%) was sufficient to evaluate any potential differences in platelet activation to the IgG1 format. Representative of literature reports, platelet activation with 5c8-IgG1/sCD40L IC was similar across all genotyped individuals. No activation was found with 5c8-CT/sCD40L IC (FIG. 18), suggesting no or minimal risk of increased TE in a patient population with an antibody formatted with the CT tail.

BMS-986004: Platelet Activation in Human Blood Donors

Figure 19:
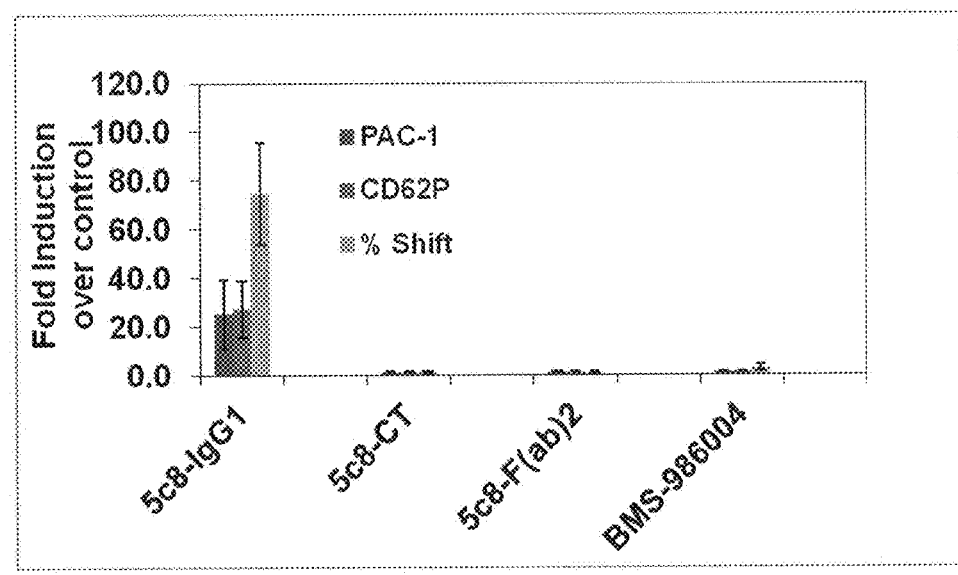
FIG. 19 diagrams platelet activation by various antibodies in blood from human donors.

The experiments described above using 5c8, supported selection of the CT-tail as the best format for BMS-986004 (also called BMS2h-572-633-CT-L2). Blood obtained from 6 donors was treated with 5c8-IgG1, 5c8-CT, F(ab)$_2$, and BMS-986004. Platelets were activated by 5c8-IgG1 but not by any of the other constructs, including BMS-986004 (FIG. 19), suggesting that this dAb has no or low risk for causing platelet activation and TE in clinical studies.

BMS-986003: Platelet Activation in Blood from Mice Expressing hFcgRIIa

Figure 20:
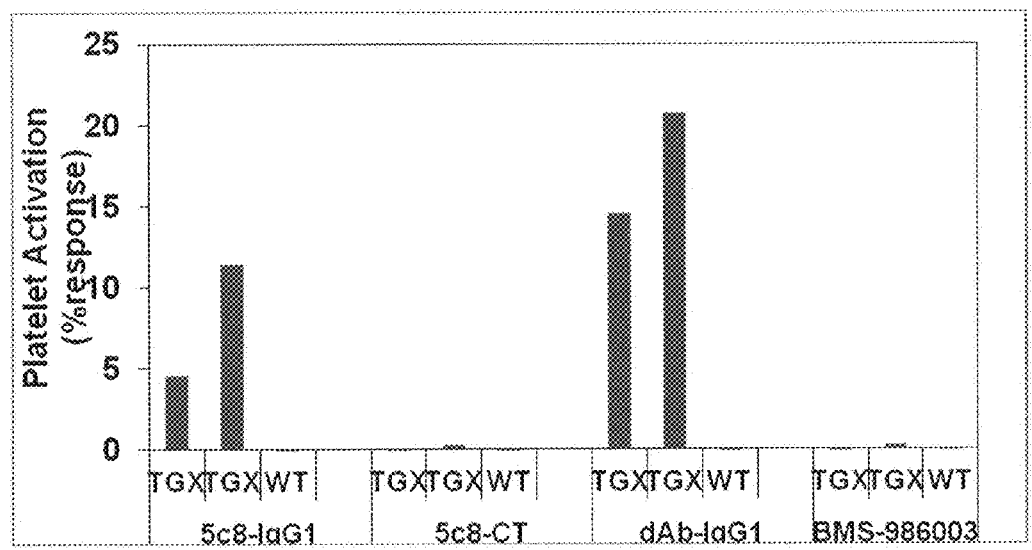
FIG. 20 shows levels of platelet activation by various antibodies, including BMS-986003, in hFcgRIIa-expressing transgenic mice.
Figure 25A:
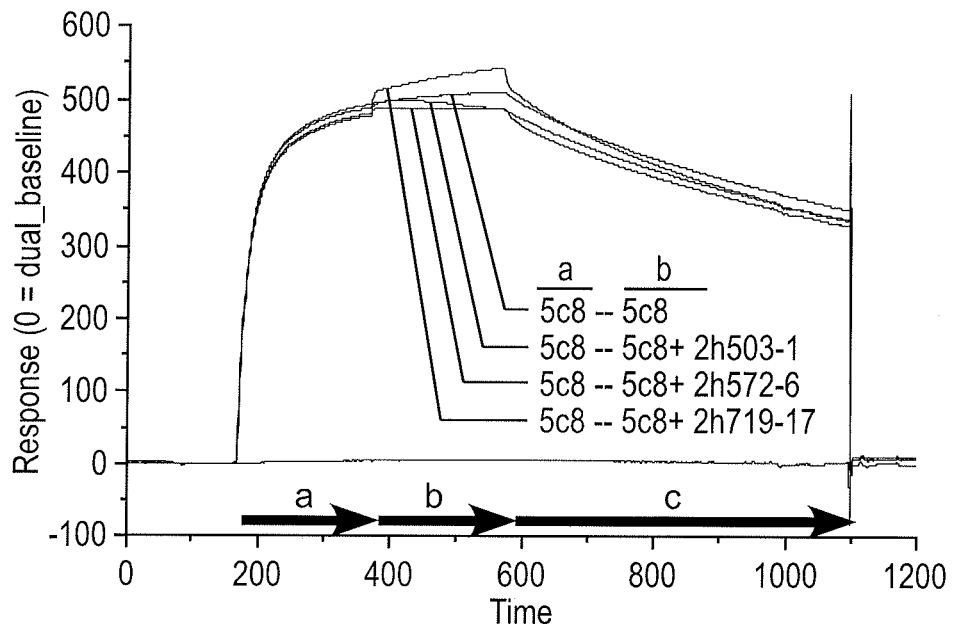
FIG. 25A, 25B, 25C, and 25D show SPR sensorgram data for binding experiments using monovalent dAbs BMS2h-503-1, BMS2h-572-6, BMS2h-719-17, and monovalent Fab fragment of 5c8, where the indicated molecules compete with each other for binding to CD40L (biotinylated IZ-hCD40L).
Figure 25B:
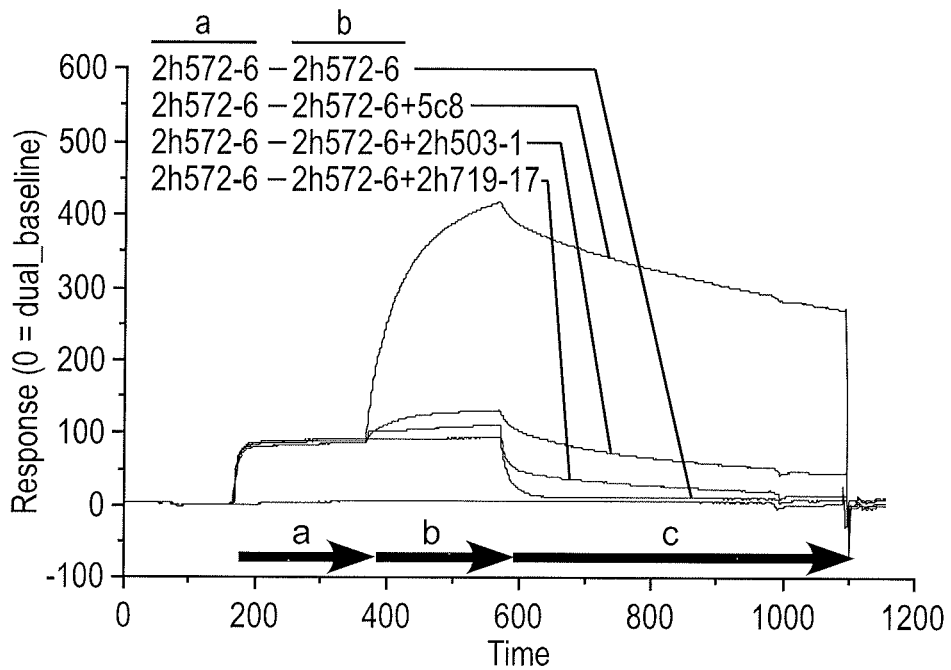
Figure 25C:
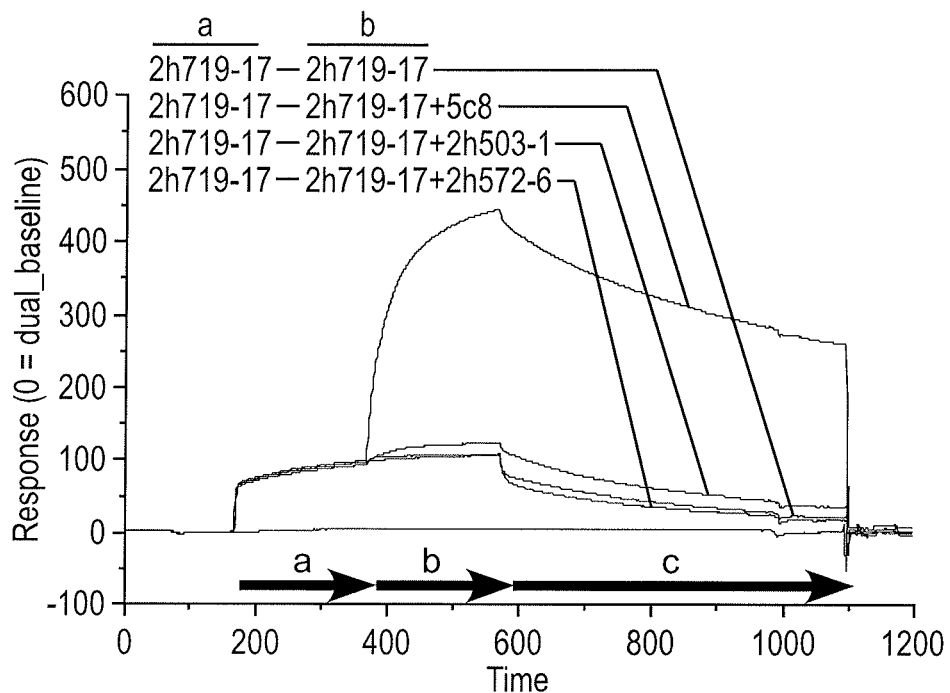
Figure 25D:
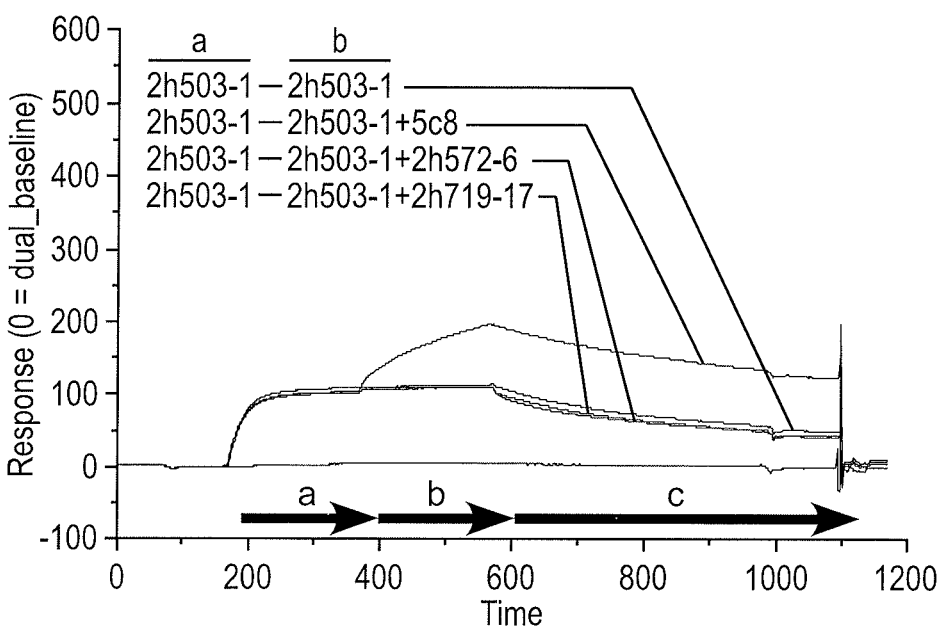

To further confirm that activation of platelets by anti-CD40L antibodies was mediated by FcgRIIa receptor, blood from transgenic mice expressing the human receptor (R131 genotype) was treated with 5c8-IgG1, 5c8-IgG2a, dAb-IgG1, 5c8-CT, and BMS-986003 (also called BMS-2h572-633-CT). Platelets were specifically activated by 5c8-IgG1, 5c8-IgG2a, and dAb-IgG1/sCD40L IC in blood from mice expressing hFcgRIIa, but not wild-type littermates. 5c8-CT and BMS-986003 did not activate platelets, further confirming a low risk for TE with the presently disclosed antibodies (FIG. 20).

Example 12

Epitope Binding Experiments

FIGS. 25A, 25B, 25C, and 25D show SPR sensorgram data for experiments designed to test whether or not monovalent dAb molecules BMS2h-503-1, BMS2h-572-6, BMS2h-719-17, and the monovalent anti-CD40L 5c8 Fab fragment compete with each other for binding to CD40L. Experiments were performed using biotinylated CD40L (biot-IZ-hCD40L) that was captured on a streptavidin sensor chip surface. The tests involved the sequential injection of a specified molecule (phase "a"), immediately followed by injection of the same molecule in the presence of a second specified molecule (phase "b"), followed by dissociation (phase "c"). Competition for binding is identified as a reduction (blocking) of the binding signal for the second molecule in the presence of the first, with the level of blocking being governed by the association and dissociation kinetics of each molecule. For each pair of molecules tested, the binding of the second molecule was shown to be reduced when the first molecule was present. These results suggest that BMS2h-503-1, BMS2h-572-6, BMS2h-719-17, and 5c8 Fab compete with each other for binding to biot-IZ-hCD40L.

Figure 26A:
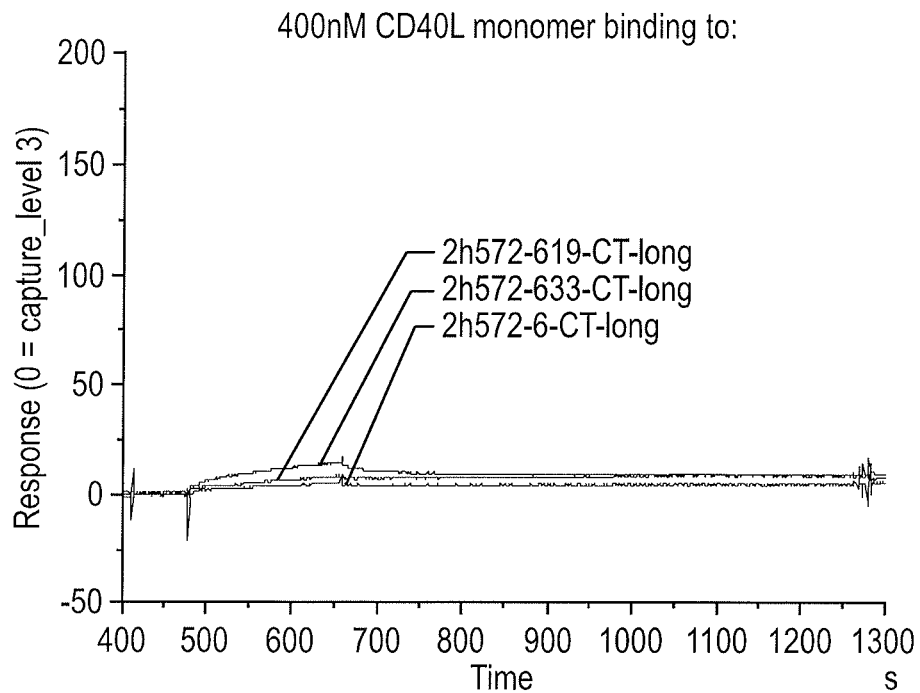
FIG. 26A, 26B, 26C, 26D, 26E, and 26F show SPR sensorgram data for experiments testing the binding of BMS2h-572-619-CT-long, BMS2h-572-633-CT-long, BMS2h-572-6-CT-long, BMS2h-719-202-CT-long, BMS2h-572-608-CT-long, BMS2h-572-634-CT-long, BMS2h-572-614-CT-long, BMS2h-572-635-CT-long, and 5c8-CT-long molecules to either CD40L monomer (FIGS. 26A, 26B, and 26C) or CD40L trimer (FIGS. 26D, 26E, and 26F).
Figure 26B:
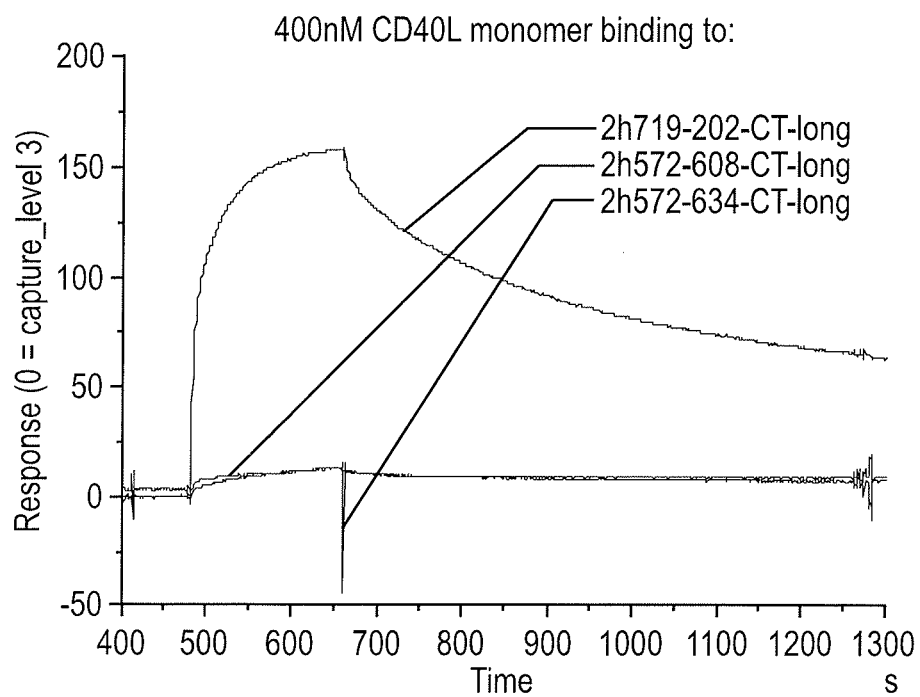
Figure 26C:
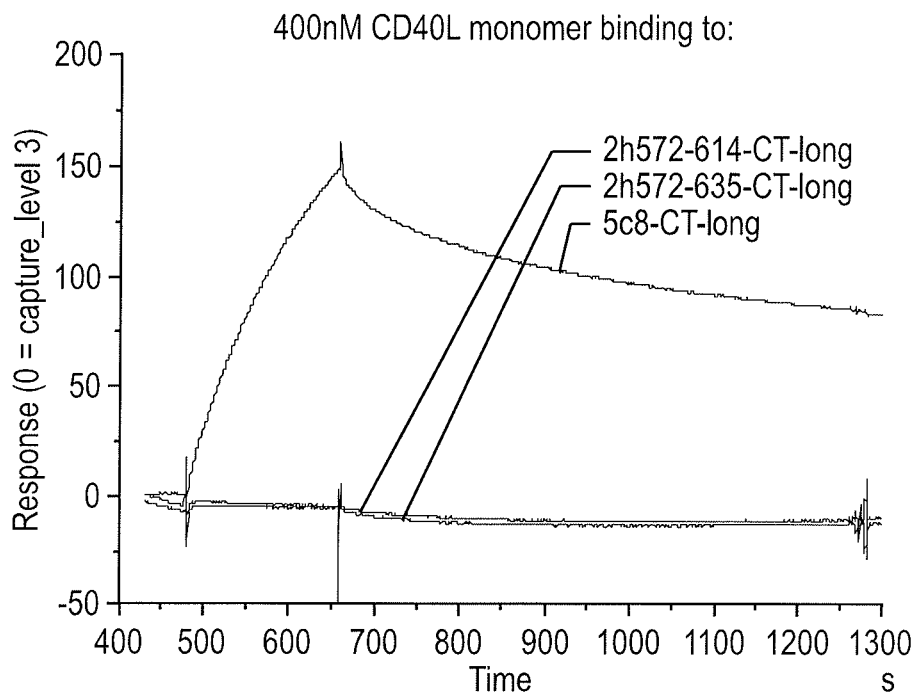
Figure 26D:
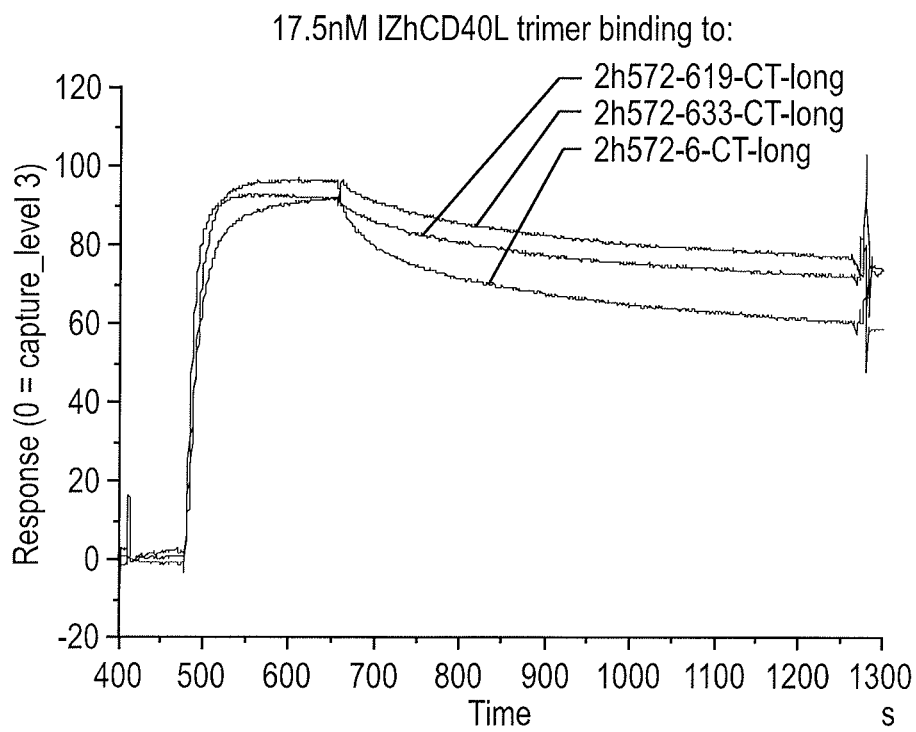
Figure 26E:
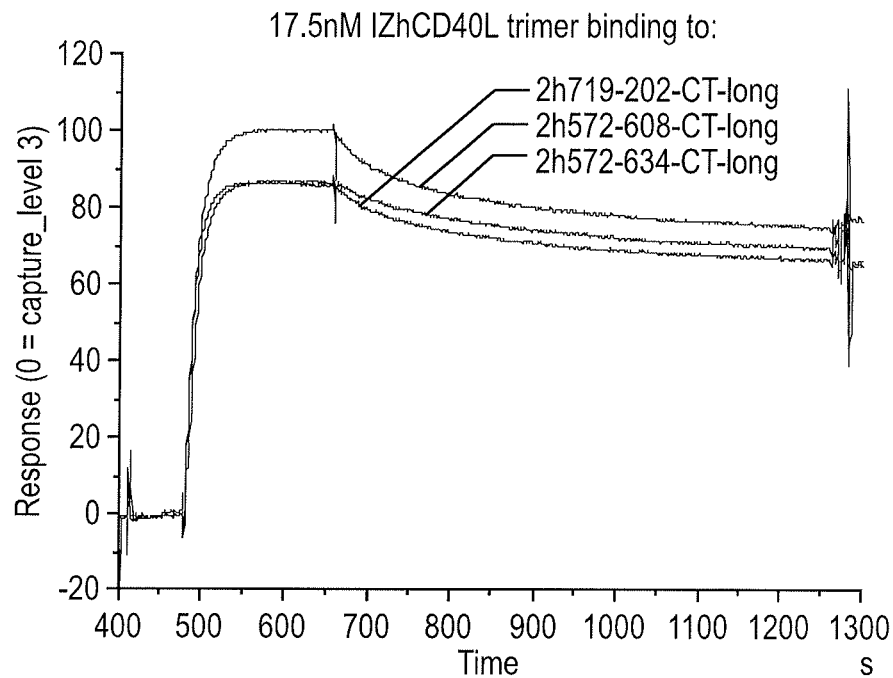
Figure 26F:
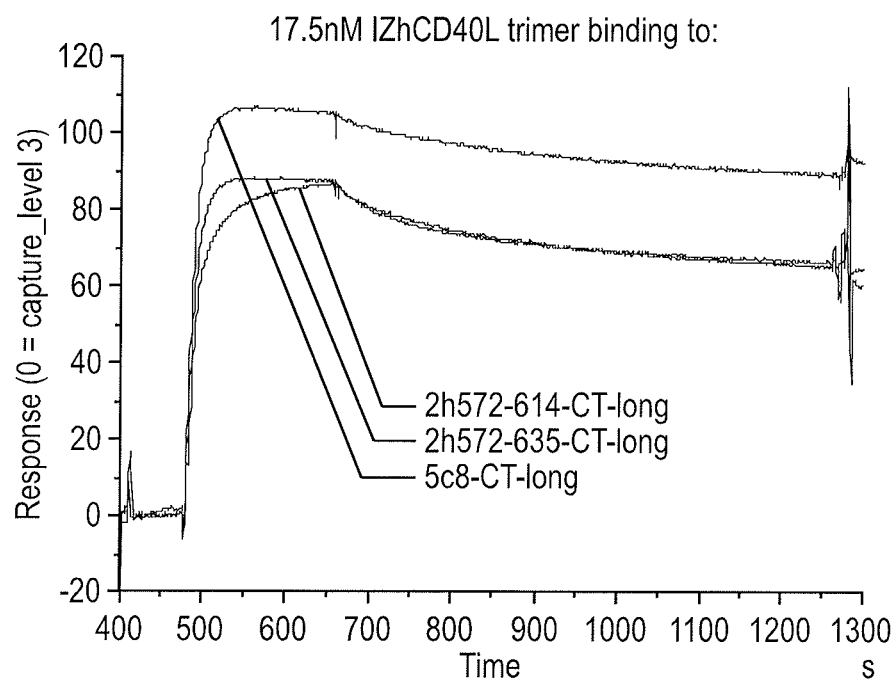

FIGS. 26A, 26B, 26C, 26D, 26E, and 26F show SPR sensorgram data for binding of the indicated dAb-CT-long and the 5c8-CT-long molecules to either human CD40L monomer (triple CD40L mutant (T211E, S222Y, H224K, [108-261])) or to CD40L trimer (IZ-hCD40L). The dAb-CT-long and the 5c8-CT-long molecules were captured via their "CT-long" Fc-domain on an immobilized anti-human IgG Fc (Biacore, GE Healthcare) antibody sensor chip surface. The data in FIGS. 26A, 26B, and 26C, show that human CD40L monomer binds specifically to BMS2h-719-202-CT-long and 5c8-CT-long, but does not bind to any of the indicated dAb-CT-long molecules that contain dAbs from the BMS2h-572-6 lineage. In contrast, FIGS. 26A, 26B, and 26C, show that CD40L trimer (IZ-hCD40L) binds strongly to all the tested dAb-CT-long molecules from the BMS2h-572-6 lineage, as well as to BMS2h-719-202-CT-long and 5c8-CT-long. These results suggest that the molecules from the BMS2h-572-6xx-CT-long lineage are specific for an epitope that is only present on the CD40L trimer and not present on monomeric human CD40L, whereas BMS2h-719-202-CT-long and 5c8-CT-long bind to an epitope that is present on both the CD40L monomer and trimer.

Although the present embodiments have been described in detail with reference to examples above, it is understood that various modifications can be made without departing from the spirit of these embodiments, and would be readily known to the skilled artisan.

SEQUENCE LISTING (1365 sequences)

SEQ ID NO: 1 - protein, 261 aa, Homo sapiens
MIETYNQTSPRSAATGLPISMKIFMYLLTVFLITQMIGSALFAVYLHRRLDKIEDERNLHEDFVFMKTIQRCNTGERSLSLLNCEEIKSQFEGFVKDIMLNKEETKKENSFEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHSSAKPCGQQSIHLGGVFELQPGASVFVNVTDPSQVSHGTGFTSFGLLKL

SEQ ID NO: 2 - protein, 5 aa, Artificial Sequence
  Description of Artificial Sequence: Synthetic peptide
  MOD_RES (2)..(2): Glu or Gln
WXLMG

SEQ ID NO: 3 - protein, 17 aa, Artificial Sequence
  Description of Artificial Sequence: Synthetic peptide
GIEGPGDVTYYADSVKG

SEQ ID NO: 4 - protein, 7 aa, Artificial Sequence
  Description of Artificial Sequence: Synthetic peptide
  MOD_RES (2)..(2): Asp or Glu
  MOD_RES (3)..(3): Ala or Ser
  MOD_RES (4)..(4): Lys, Asn or ARg
KXXXSDY

SEQ ID NO: 5 - protein, 30 aa, Artificial Sequence
  Description of Artificial Sequence: Synthetic polypeptide
EVQLLESGGGLVQPGGSLRLSCAASGFTFN

SEQ ID NO: 6 - protein, 14 aa, Artificial Sequence
  Description of Artificial Sequence: Synthetic peptide
  MOD_RES (2)..(2): Ala or Val
WXRQAPGKGLEWVS

SEQ ID NO: 7 - protein, 34 aa, Artificial Sequence
  Description of Artificial Sequence: Synthetic polypeptide
RTFISRDNSKNTLYLQMNSLRAEDTAVYYCVKVG

SEQ ID NO: 8 - protein, 11 aa, Artificial Sequence
  Description of Artificial Sequence: Synthetic peptide
RGQGTLVTVSS

SEQ ID NO: 9 - protein, 116 aa, Artificial Sequence
  Description of Artificial Sequence: Synthetic polypeptide
  MOD_RES (30)..(30): Lys or Asn
  MOD_RES (31)..(31): Arg, Lys, Ser or Thr
  MOD_RES (35)..(35): Met or Gln
  MOD_RES (62)..(62): Asp or Glu
  MOD_RES (98)..(98): Asp or Glu
  MOD_RES (103)..(103): Phe, Met or Leu
EVQLLESGGGLVQPGGSLRLSCAASGFTFXXYEMXWVRQAPGKGLEWVSSISSDGSFTYYAXSVKGRFTISRDNSKNTLYLQMNSLRAEDTAVYYCAXPFTEXDYWGHGTLVTVSS

SEQ ID NO: 10 - protein, 108 aa, Artificial Sequence
  Description of Artificial Sequence: Synthetic polypeptide
  MOD_RES (28)..(28): His or Asp
DIQMTQSPSSLSASVGDRVTITCRASHXIQRYLSWYQQKPGKAPKLLILWGSQLQSGVPSRFSGSGSGTDFTLTISSLQPEDFATYYCGQWWAPPQTFGQGTKVEIKR

SEQ ID NO: 11 - protein, 108 aa, Artificial Sequence
  Description of Artificial Sequence: Synthetic polypeptide
  MOD_RES (14)..(14): Ser or Tyr
  MOD_RES (83)..(83): Leu or Phe
  MOD_RES (85)..(85): Thr or Lys
  MOD_RES (100)..(100): Lys, Arg or Gln
DIQMTQSPSSLSAXVGDRVTITCRASQPIGPDLLWYQQKPGKAPKLLIYQTSILRSGVPSRFSGSGSETDFTLTISNLQPEDXAXYYCQQYWAFPVTFGXGTKVVIKR

SEQ ID NO: 12 - protein, 25 aa, Artificial Sequence
  Description of Artificial Sequence: Synthetic peptide
  misc_feature (1)..(25): This sequence may encompass 1 to 5 'Gly Gly Gly Gly Ser' repeating units
GGGGSGGGGSGGGGSGGGGSGGGGS

SEQ ID NO: 13 - protein, 6 aa, Artificial Sequence
  Description of Artificial Sequence: Synthetic peptide
TVAAPS

SEQ ID NO: 14 - protein, 7 aa, Artificial Sequence
  Description of Artificial Sequence: Synthetic peptide
ASTSGPS

SEQ ID NO: 15 - protein, 117 aa, Artificial Sequence
  Description of Artificial Sequence: Synthetic polypeptide
EVQLLESGGGLVQPGGSLRLSCAASGFTFIAYDMSWVRQAPGKGLEWVSWIDEWGLQTYYADSVKGRFTISRDNSKNTLYLQMNSLRAEDTAVYYCAKKTPEEFDYWGQGTLVTVSS

SEQ ID NO: 16 - protein, 116 aa, Artificial Sequence
  Description of Artificial Sequence: Synthetic polypeptide
EVQLLESGGGLVQPGGSLRLSCAASGFTFGDYEMSWVRQAPGKGLEWVSGIDGEGSDTYYADSVKGRFTISRDNSKNTLYLQMNSLRAEDTAVYYCAKPGRSFDYWGQGTLVTVSS

SEQ ID NO: 17 - protein, 124 aa, Artificial Sequence
  Description of Artificial Sequence: Synthetic polypeptide
EVQLLESGGGLVQPGGSLRLSCAASGFTFERYPMTWVRQAPGKGLEWVSTIHGSGSATYYADSVKGRFTISRDNSKNTLYLQMNSLRAEDTAVYYCAKGPYTSRHNSLGHFDYWGQGTLVTVSS

SEQ ID NO: 18 - protein, 123 aa, Artificial Sequence
  Description of Artificial Sequence: Synthetic polypeptide
EVQLLESGGGLVQPGGSLRLSCAASGFTFMDYPMGWVRQAPGKGLEWVSSIGPVGMSTYYADSVKGRFTISRDNSKNTLYLQMNSLRAEDTAVYYCAKYGGTSGRHNTKFDYWGQGTLVTVSS

SEQ ID NO: 19 - protein, 123 aa, Artificial Sequence
  Description of Artificial Sequence: Synthetic polypeptide
EVQLLESGGGLVQPGGSLRLSCAASGFTFTEYPMSWVRQAPGKGLEWVSVISPLGFTTYYADSVKGRFTISRDNSKNTLYLQMNSLRAEDTAVYYCAKWTGGSGILNSSFDYWGQGTLVTVSS

SEQ ID NO: 20 - protein, 123 aa, Artificial Sequence
  Description of Artificial Sequence: Synthetic polypeptide
EVQLLESGGGLVQPGGSLRLSCAASGFRVSNYDLTWVRQAPGKGLEWVSTISATNGSTYYADSVKGRFTISRDNSKNTLYLQMNSLRAEDTAVYYCAAVTWWLLRHNDNLGFWGQGTLVTVSS

SEQ ID NO: 21 - protein, 121 aa, Artificial Sequence
  Description of Artificial Sequence: Synthetic polypeptide
EVQLLESGGGLVQPGGSLRLSCAASGFSISYKNMAWVRQAPGKGLEWVSAIKAANGSTYYADSVKGRFTISRDNSKNTLYLQMNSLRAEDTAVYYCATGSQKKRTYTFDFWGQGTLVTVSS

SEQ ID NO: 22 - protein, 118 aa, Artificial Sequence
  Description of Artificial Sequence: Synthetic polypeptide
EVQLLESGGGLVQPGGSLRLSCAASGFTFRLYEMAWVRQAPGKGLEWVSGIDILGSRTYYADSVKGRFTISRDNSKNTLYLQMNSLRAEDTAVYYCAKDLSWQGFDYWGQGTLVTVSS

SEQ ID NO: 23 - protein, 123 aa, Artificial Sequence
  Description of Artificial Sequence: Synthetic polypeptide
EVQLLESGGGLVQPGGSLRLSCAASGFTFRSYTMGWVRQAPGKGLEWVSSINPMGYQTYYADSVKGRFTISRDNSKNTLYLQMNSLRAEDTAVYYCAKHGVGKGTKPHNFDYWGQGTLVTVSS

SEQ ID NO: 24 - protein, 123 aa, Artificial Sequence
  Description of Artificial Sequence: Synthetic polypeptide
EVQLLESGGGLVQPGGSLRLSCAASGFTFELYRMSWVRQAPGKGLEWVSEISGSGFPTYYADSVKGRFTISRDNSKNTLYLQMNSLRAEDTAVYYCAKSLHDKTQHHQEFDYWGQGTLVTVSS

SEQ ID NO: 25 - protein, 118 aa, Artificial Sequence
  Description of Artificial Sequence: Synthetic polypeptide
EVQLLESGGGLVQPGGSLRLSCAASGFTFIEYPMRWVRQAPGKGLEWVSLISPSGVFTYYADSVKGRFTISRDNSKNTLYLQMNSLRAEDTAVYYCAKGDESSTFDYWGQGTLVTVSS

SEQ ID NO: 26 - protein, 124 aa, Artificial Sequence
  Description of Artificial Sequence: Synthetic polypeptide
EVQLLESGGGLVQPGGSLRLSCAASGFTFKRYDMDWVRQAPGKGLEWVSTIGSSGYPTYYADSVKGRFTISRDNSKNTLYLQMNSLRAEDTAVYYCAERMPGYFPGFARQFDYWGQGTLVTVSS

SEQ ID NO: 27 - protein, 124 aa, Artificial Sequence
  Description of Artificial Sequence: Synthetic polypeptide
EVQLLESGGGLVQPGGSLRLSCAASGFTFWRYAMGWVRQAPGKGLEWVSTINDEGRETYYADSVKGRFTISRDNSKNTLYLQMNSLRAEDTAVYYCAKKRVSSSVNAPYEFDYWGQGTLVTVSS

SEQ ID NO: 28 - protein, 123 aa, Artificial Sequence
  Description of Artificial Sequence: Synthetic polypeptide
EVQLLESGGGLVQPGGSLRLSCAASGFTFANYSMSWVRQAPGKGLEWVSSIDRLGTHTYYADSVKGRFTISRDNSKNTLYLQMNSLRAEDTAVYYCAKVLADLIAGHAEFDYWGQGTLVTVSS

SEQ ID NO: 29 - protein, 124 aa, Artificial Sequence
  Description of Artificial Sequence: Synthetic polypeptide
EVQLLESGGGLVQPGGSLRLSCAASGFTFPSYDMAWVRQAPGKGLEWVSGISRSGSMTYYADSVKGRFTISRDNSKNTLYLQMNSLRAEDTAVYYCAKGVDAHVYYMEPFFDYWGQGTLVTVSS

SEQ ID NO: 30 - protein, 116 aa, Artificial Sequence
  Description of Artificial Sequence: Synthetic polypeptide
EVQLLESGGGLVQPGGSLRLSCAASGFTFERYQMAWVRQAPGKGLEWVSTISSDGGGTYYADSVKGRFTISRDNSKNTLYLQMNSLRAEDTAVYYCAKPGTVFDYWGQGTLVTVSS

SEQ ID NO: 31 - protein, 116 aa, Artificial Sequence
  Description of Artificial Sequence: Synthetic polypeptide
EVQLLESGGGLVQPGGSLRLSCAASGFTFPKYEMAWVRQAPGKGLEWVSSIDGDGKSTYYADSVKGRFTISRDNSKNTLYLQMNSLRAEDTAVYYCAKPDQFFDYWGQGTLVTVSS

SEQ ID NO: 32 - protein, 123 aa, Artificial Sequence
  Description of Artificial Sequence: Synthetic polypeptide
EVQLLESGGGLVQPGGSLRLSCAASGFTFSYYSMYWVRQAPGKGLEWVSSISPFGWGTYYADSVKGRFTISRDNSKDTLYLQMNSLRAEDTAVYYCAKYGETSGPISENFDYWGQGTLVTVSS

SEQ ID NO: 33 - protein, 116 aa, Artificial Sequence
  Description of Artificial Sequence: Synthetic polypeptide
EVQLLESGGGLVQPGGSLRLSCTASGFTFAGYQMSWVRQAPGKGLEWVSSITNEGVSTYYADSVKGRFTISRDNSKNTLYLQMNSLRAEDTAVYYCAKPGKYFDYWGQGTLVTVSS

SEQ ID NO: 34 - protein, 116 aa, Artificial Sequence
  Description of Artificial Sequence: Synthetic polypeptide
EVQLLESGGGLVQPGGSLRLSCAASGFTFGEYEMVWVRQAPGKGLEWVSSITSDGLSTYYADSVKGRFTISRDNSKNTLYLQMNSLRAEDTAVYYCAKPGIRFDYWGQGTLVTVSS

SEQ ID NO: 35 - protein, 116 aa, Artificial Sequence
  Description of Artificial Sequence: Synthetic polypeptide
EVQLLESGGGLVQPGGSLRLSCAASGFTFADYDMAWVRQAPGKGLEWVSGIVDDGLMTYYADSVKGRFTISRDNSKNTLYLQMNSLRAEDTAVYYCAKPDVAFDYWGQGTLVTVSN

SEQ ID NO: 36 - protein, 123 aa, Artificial Sequence
  Description of Artificial Sequence: Synthetic polypeptide
EVQLLESGGGLVQPGGSLRLSCAASGFTFIGYAMAWVRQAPGKGLEWVSSIGPLGATTYYADSVKGRFTISRDNSKNTLYLQMNSLRAEDTAVYYCAKLPAGTSSHSVDFDYWGQGTLVTVSS

SEQ ID NO: 37 - protein, 116 aa, Artificial Sequence
  Description of Artificial Sequence: Synthetic polypeptide
EVQLLESGGGLVQPGGSLRLSCAASGFTFADYEMTWVRQAPGKGLEWVSSITSDGVSTYYADSVKGRFTISRDNSKNTLYLQMNSLRAEDTAVYYCAKPSVQFDYWGQGTLVTVSS

SEQ ID NO: 38 - protein, 121 aa, Artificial Sequence
  Description of Artificial Sequence: Synthetic polypeptide
EVQLLESGGGLVQPGGSLRLSCAASGFTFRRYVMGWVRQAPGKGLEWVSWIEADGRTTYYADSVKGRFTISRDNSKNTLYLQMNSLRAEDTAVYYCAKGLTDQHVIEFDYWGQGTLVTVSS

SEQ ID NO: 39 - protein, 117 aa, Artificial Sequence
  Description of Artificial Sequence: Synthetic polypeptide
EVQLLESGGGLVQPGGSLRLSCAASGFTFDGYRMGWVRQAPGKGLEWVSSIAPDGNYTYYADSVKGRFTISRDNSKNTLYLQMNSLRAEDTAVYYCAKFWGMQFDYWGQGTLVTVSS

SEQ ID NO: 40 - protein, 120 aa, Artificial Sequence
  Description of Artificial Sequence: Synthetic polypeptide
EVQLLESGGGLVQPGGSLRLSCAASGFTFASYPMGWVRQAPGKGLEWVSSIGPIGFTTYYADSVKGRFTISRDNSKNTLYLQMNSLRAEDTAVYYCAEMKSPYKPQFDYWGQGTLVTVSS

SEQ ID NO: 41 - protein, 120 aa, Artificial Sequence
  Description of Artificial Sequence: Synthetic polypeptide
EVQLLESGGGLVQPGGSLRLSCAASGFTFLAYWMVWVRQAPGKGLEWVSSISPSGTHTYYADSVKGRFTISRDNSKNTLYLQMNSLRVEDTAVYYCAKYTEPGLGSFDYWGQGTLVTVSS

SEQ ID NO: 42 - protein, 119 aa, Artificial Sequence
  Description of Artificial Sequence: Synthetic polypeptide
EVQLLESGGGLVQPGGSLRLSCAASGFTFSNYEMGWVRQAPGKGLEWVSVISEVGSLTYYADSVKGRFTISRDNSKNTLYLQMNSLRAEDTAVYYCAKPHDSSIGFDYWGQGTLVTVSS

SEQ ID NO: 43 - protein, 116 aa, Artificial Sequence
  Description of Artificial Sequence: Synthetic polypeptide
EVQLLESGGGLVQPGGSLRLSCAASGFTFWSYDMTWVRQAPGKGLEWVSSIMASGDDTYYADSVKGRFTISRDNSKNTLYLQMNSLRAEDTAVYYCAKWDRDFDYWGQGTLVTVSS

SEQ ID NO: 44 - protein, 120 aa, Artificial Sequence
  Description of Artificial Sequence: Synthetic polypeptide
EVQLLESGGGLVQPGGSLRLSCAASGFTFEEYVMSWVRQAPGKGLEWVSTISPIGLTTYYADSVKGRFTISRDNSKNTLYLQMNSLRAEDTAVYYCAEFPLIILPDFDYWGQGTLVTVSS

SEQ ID NO: 45 - protein, 123 aa, Artificial Sequence
  Description of Artificial Sequence: Synthetic polypeptide
EVQLLESGGGLVQPGGSLRLSCAASGFTFMEYAMIWVRQAPGKGLEWVSIISPLGLSTYYADSVKGRFTISRDNSKNTLYLQMNSLRAEDTAVYYCAKYQDSSDSQYTNFDYWGQGTLVTVSS

SEQ ID NO: 46 - protein, 121 aa, Artificial Sequence
  Description of Artificial Sequence: Synthetic polypeptide
EVQLLESGGGLVQPGGSLRLSCAASGFTFEDYGMGWARQAPGKGLEWVSSIGPLGLWTYYADSAKGRFTISRDNSKNTLYLQMNSLRAEDTAVYYCAKSPLEGLITNFDYWGQGTLVTVSS

SEQ ID NO: 47 - protein, 119 aa, Artificial Sequence
  Description of Artificial Sequence: Synthetic polypeptide
EVQLLESGGGLVQPGGSLRLSCAASGFTFDAYEMGWVRQAPGKGLEWVSIIDWDGNSTYYADSVKGRFTISRDNSKNTLYLQMNSLRAEDTAVYYCAKPGDNVGIFDYWGQGTLVTVSS

SEQ ID NO: 48 - protein, 122 aa, Artificial Sequence
  Description of Artificial Sequence: Synthetic polypeptide
EVQLLESGGGLVQPGGSLRLSCAASGFTFSNYYMVWVRQAPGKGLEWVSAIDEWGFATYYADSVKGRFTISRDNSKNTLYLQMNSLRAEDTAVYYCAKHWEFTSDTSRFDYWGQGTLVTVSS

SEQ ID NO: 49 - protein, 116 aa, Artificial Sequence
  Description of Artificial Sequence: Synthetic polypeptide
EVQLLESGGGLVQPGGSLRLSCAASGFTFEDFDMAWVRQAPGKGLEWVSSINDQGSLTYYADSVKGRFTISRDNSKNTLYLQMNSLRAEDTAVYYCAKPDQFFDYWGQGTLVTVSS

SEQ ID NO: 50 - protein, 122 aa, Artificial Sequence
  Description of Artificial Sequence: Synthetic polypeptide
EVQLLESGGGLVQPGGSLRLSCAASGFTFSAYDMMWVRQAPGKGLEWVSRISPQGQRTYYADSVKGRFTISRDNSKNTLYLQMNSLRAEDTAVYYCAKIRGQSRIPMRFDYWGQGTLVTVSS

SEQ ID NO: 51 - protein, 119 aa, Artificial Sequence
  Description of Artificial Sequence: Synthetic polypeptide
EVQLLESGGGLVQPGGSLRLSCAASGFTFPEYDMTWVRQAPGKGLEWVSYISSDGYSTYYADSVKGRFTISRDNSKNTLYLQMNSLRAEDTAVYYCAKPHGSPREFDYWGQGTLVTVSS

SEQ ID NO: 52 - protein, 116 aa, Artificial Sequence
  Description of Artificial Sequence: Synthetic polypeptide
EVQLLESGGGLVQPGGSLRLSCAASGFTFTDYEMGWVRQAPGKGLEWVSTITSLGESTYYADSVKGRFTISRDNSKNTLYLQMNSLRAEDTAVYYCAKPGRIFDYWGQGTLVTVSS

SEQ ID NO: 53 - protein, 123 aa, Artificial Sequence
  Description of Artificial Sequence: Synthetic polypeptide
EVQLLESGGGLVQPGGSLRLSCAASGFTFAFYPMMWVRQAPGKGLEWVSWIDATGTRTYYADSVKGRFTISRDNSKNTLYLQMNSLRAEDTAVYYCAEGNYGSSYTMGVFDYWGQGTLVTVSS

SEQ ID NO: 54 - protein, 122 aa, Artificial Sequence
  Description of Artificial Sequence: Synthetic polypeptide
EVQLLESGGGLVQPGGSLRLSCAASGFTFDEYPMYWVRQAPGKGLEWVSSIGPSGPNTYYADSVKGRFTISRDNSKNTLYLQMNSLRAEDTAVYYCAKSPYFDVIPSYFDYWGQGTLVTVSS

SEQ ID NO: 55 - protein, 119 aa, Artificial Sequence
  Description of Artificial Sequence: Synthetic polypeptide
EVQLLESGGGLVQPGGSLRLSCAASGFTFADYGMGWVRQAPGKGLEWVSSIQSSGLRTYYADSVKGRFTISRDNSKNTLYLQMNSLRAEDTAVYYCAKRANSRRGFDYWGQGTLVTVSS

SEQ ID NO: 56 - protein, 116 aa, Artificial Sequence
  Description of Artificial Sequence: Synthetic polypeptide
EVQLLESGGGLVQPGGSLRLSCAASGFTFSDYEMMWVRQAPGKGLEWVSSITSHGGSTYYADSVKGRFTISRDNSKNTLYLQMNSLRAEDTAVYYCAKPDKDFDYWGQGTLVTVSS

SEQ ID NO: 57 - protein, 122 aa, Artificial Sequence
  Description of Artificial Sequence: Synthetic polypeptide
EVQLLESGGGLVQPGGSLRLSCAASGFTFAHYPMSWVRQAPGKGLEWVSSIGRLGNRTYYADSVKGRFTISRDNSKNTLYLQMNSLRAEDTAVYYCAKRATPVPIKGLFDYWGQGTLVTVSS

SEQ ID NO: 58 - protein, 116 aa, Artificial Sequence
  Description of Artificial Sequence: Synthetic polypeptide
EVQLLESGGGLVQPGGSLRLSCAASGLTFGRYEMAWVRQAPGKGLEWVSSIDSDGWVTYYADSVKGRFTISRDNSKNTLYLQMNSLRAEDTAVYYCAQPDSLFDYWGQGTLVTVSS

SEQ ID NO: 59 - protein, 117 aa, Artificial Sequence
  Description of Artificial Sequence: Synthetic polypeptide
EVQLLESGGGLVQPGGSLRLSCAASGFTFSSYSMVWVRQAPGKGLEWVSGINRGGTRTYYADSVKGRFTISRDNSKNTLYLQMNSLRAEDTAVYYCAKGWRRGFDYWGQGTLVTVSS

SEQ ID NO: 60 - protein, 117 aa, Artificial Sequence
  Description of Artificial Sequence: Synthetic polypeptide
EVQLLESGGGLVQPGGSLRLSCAASGFTFTRYRMSWVRQAPGKGLEWVSGISRDGYRTYYADSVKGRFTISRDNSKNTLYLQMNSLRAEDTAVYYCAKGMTASFDYWGQGTLVTVSS

SEQ ID NO: 61 - protein, 118 aa, Artificial Sequence
  Description of Artificial Sequence: Synthetic polypeptide
EVQLLESGGGLVQPGGSLRLSCAASGFTFQMYPMGWVRQAPGKGLEWVSMIEPAGDLTYYADSVKGRFTISRDNSKNTLYLQMNSLRAEDTAVYYCAKYQEQPWFDYWGQGTLVTVSS

SEQ ID NO: 62 - protein, 116 aa, Artificial Sequence
  Description of Artificial Sequence: Synthetic polypeptide
EVQLLESGGGLVQPGGSLRLSCAASGFPFPQYQMAWVRQAPGKGLEWVSMITSDGLDTYYADSVKGRFTISRDNSKNTLYLQMNSLRAEDTAVYYCAKPEPLFDYWGQGTLVTVSS

SEQ ID NO: 63 - protein, 116 aa, Artificial Sequence
  Description of Artificial Sequence: Synthetic polypeptide
EVQLLESGGGLVQPGGSLRLSCAASGFTFSMYDMHWVRQAPGKGLEWVSTILSDGTDTYYADSVKGRFTISRDNSKNTLYLQMNSLRAEDTAVYYCAKYGAMFDYWGQGTLVTVSS

SEQ ID NO: 64 - protein, 118 aa, Artificial Sequence
  Description of Artificial Sequence: Synthetic polypeptide
EVQLLESGGGLVQPGGSLRLSCAASGFTFKLYPMTWVRQAPGKGLEWVSSIDAGGHETYYADSVKGRFTISRDNSKNTLYLQMNSLRAEDTAVYYCAKDWWDYLFDYWGQGTLVTVSS

SEQ ID NO: 65 - protein, 117 aa, Artificial Sequence
  Description of Artificial Sequence: Synthetic polypeptide
EVQLLESGGGLVQPGGSLRLSCAASGFTFSRYPMSWVRQAPGKGLEWVSSINRSGMRTYYADSVKGRFTISRDNSKNTLYLQMNSLRAEDTAVYYCAEGHQAPFDYWGQGTLVTVSS

SEQ ID NO: 66 - protein, 123 aa, Artificial Sequence
  Description of Artificial Sequence: Synthetic polypeptide
EVQLLESGGGLVQPGGSLRLSCAASGFTFTGYAMSWVRQAPGKGLEWVSTINANGIRTYYADSVKGRFTISRDNSKNTLYLQMNGLRAEDTAVYYCAKGGVWRWGTGHKFDYWGQGTLVTVSS

SEQ ID NO: 67 - protein, 118 aa, Artificial Sequence
  Description of Artificial Sequence: Synthetic polypeptide
EVQLLESGGGLVQPGGSLRLSCAASGFTFKQYDMRWVRQAPGKGLEWVSTISQNGTKTYYADSVKGRFTISRDNSKNTLYLQMNSLRAEDTAVYYCAKSRTGRYFDYWGQGTLVTVSS

SEQ ID NO: 68 - protein, 123 aa, Artificial Sequence
  Description of Artificial Sequence: Synthetic polypeptide
EVQLLESGGGLVQPGGSLRLSCAASGFTFGTYDMGWVRQAPGKGLEWVSRINWQGDRTYYADSVKGRFTISRDNSKNTLYLQMNSLRAEDTAVYYCAKAGFGHYVDGLGFDYWGQGTLVTVSS

SEQ ID NO: 69 - protein, 116 aa, Artificial Sequence
  Description of Artificial Sequence: Synthetic polypeptide
EVQLLESGGGLVQPGGSLRLSCAASGFTFSGYEMAWVRQAPGKGLEWVSSITDMGDSTYYADSVKGRFTISRDNSKNTLYLQMNSLRAEDTAVYYCAKPGTAFDYWGPGTLVTVSS

SEQ ID NO: 70 - protein, 117 aa, Artificial Sequence
  Description of Artificial Sequence: Synthetic polypeptide
EVQLLESGGGLVQPGGSLRLSCAASGFTFAKYKMWWVRQAPGKGLEWVSSITPKGHSTYYADSVKGRFTISRDNSKNTLYLQMNSLRAEDTAVYYCAKRPMTPFDYWGQGTLVTVSS

SEQ ID NO: 71 - protein, 122 aa, Artificial Sequence
  Description of Artificial Sequence: Synthetic polypeptide
EVQLLESGGGLVQPGGSLRLSCAASGFTFERYNMSWVRQAPGKGLEWVSSIRPRGGKTYYADSVKGRFTISRDNSKNTLYLQMNSLRAEDTAVYYCAKWRREGYTGSKFDYWGQGTLVTVSS

SEQ ID NO: 72 - protein, 118 aa, Artificial Sequence
  Description of Artificial Sequence: Synthetic polypeptide
EVQLLESGGGLVQPGGSLRLSCAASGFTFERYGMTWVRQAPGKGLEWVSSIWPRGQKTYYADSVKGRFTISRDNSKNTLYLQMNSLRAEDTAVYYCAKGNSRYVFDYWGQGTLVTVSS

SEQ ID NO: 73 - protein, 116 aa, Artificial Sequence
  Description of Artificial Sequence: Synthetic polypeptide
EVQLLESGGGLVQPGGSLRLSCAASGFTFSDYEMMWVRQAPGKGLEWVSTITSDGISTYYADSVKGRFTIFRDNSKNTLYLQMNSLRAEDTAVYYCAKSGRFFDYWGQGTLVTVSS

SEQ ID NO: 74 - protein, 116 aa, Artificial Sequence
  Description of Artificial Sequence: Synthetic polypeptide
EVQLLESGGGLVQPGGSLRLSCAASGFTFSGYQMAWVRQAPGKGLEWVSGISSEGLTTYYADSVKGRFTISRDNSKNTLYLQMNSLRAEDTAVYYCAKLGRRFDYWGQGTLVTVSS

SEQ ID NO: 75 - protein, 120 aa, Artificial Sequence
  Description of Artificial Sequence: Synthetic polypeptide
EVQLLESGGGLVQPGGSLRLSCAASGFTFTNYSMGWVRQAPGKGLEWVSTIRPNGTKTYYADSVKGRFTISRDNSKNTLYLQMNSLRAEDTAVYYCAKRSSAHLQRFDYWGQGTLVTVSS

SEQ ID NO: 76 - protein, 119 aa, Artificial Sequence
  Description of Artificial Sequence: Synthetic polypeptide
EVQLLESGGGLVQPGGSLRLSCAASGFTFGNYSMGWVRQAPGKGLEWVSSIGRHGGRTYYADSVKGRFTISRDNSKNTLYLQMNSLRAEDTAVYYCAKKGSTYPRFDYWGQGTLVTVSS

SEQ ID NO: 77 - protein, 118 aa, Artificial Sequence
  Description of Artificial Sequence: Synthetic polypeptide
EVQLLESGGGLVQPGGSLRLSCTASGFTFSHYEMGWVRQAPGKGLEWVSSIEPFGGGTYYADSVKGRFTISRDNSKNTLYLQMNSLRAEDTAVYYCAKVYPQGSFDYWGQGTLVTVSS

SEQ ID NO: 78 - protein, 124 aa, Artificial Sequence
  Description of Artificial Sequence: Synthetic polypeptide
EVQLLESGGGLVQPGGSLRLSCAASGFTFSNYTMGWVRQAPGKGLEWVSSIRPDGKITYYADSVKGRFTISRDNSKNTLYLQMNSLRAEDTAVYYCAEVYSSCAMCTPLLFDYWGQGTLVTVSS

SEQ ID NO: 79 - protein, 123 aa, Artificial Sequence
  Description of Artificial Sequence: Synthetic polypeptide
EVQLLESGGGLVQPGGSLRLSCAASGFTFKRYSMAWVRQAPGKGLEWVSDIGPRGFSTYYADSVKGRFTISRDNSKNTLYLQMNSLRAEDTAVYYCAKVGRGQRDTSQPFDYWGQGTLVTVSS

SEQ ID NO: 80 - protein, 116 aa, Artificial Sequence
  Description of Artificial Sequence: Synthetic polypeptide
EVQLLESGGGLVQPGGSLRLSCAASGFTFASYQMAWVRQAPGKGLEWVSGITSGGLSTYYADSVKGRFTISRDNSKNTLYLQMNSLRAEDTAVYYCAKPGRGFDYWGQGTLVTVSS

SEQ ID NO: 81 - protein, 116 aa, Artificial Sequence
  Description of Artificial Sequence: Synthetic polypeptide
EVQLLESGGGLVQPGGSLRLSCAASGFTFASYEMTWVRQAPGKGLEWVSGISSDGLSTYYADSVKGRFTISRDNSKNTLYLQMNSLRAEDTAVYYCAKPGVLFDYWGQGTLVTVSS

SEQ ID NO: 82 - protein, 117 aa, Artificial Sequence
  Description of Artificial Sequence: Synthetic polypeptide
EVQLLESGGGLVQPGGSLRLSCAASGFTFDKYLMSWVRQAPGKGLEWVSGIEPLGDVTYYADSVKGRFTISRDNSKNTLYLQMNSLRAEDTAVYYCAKEASGDFDYWGQGTLVTVSS

SEQ ID NO: 83 - protein, 116 aa, Artificial Sequence
  Description of Artificial Sequence: Synthetic polypeptide
EVQLLESGGGLVQPGGSLRLSCAASGFTFTEYEMSWVRQAPGKGLEWVSSIDNVGSSTYYADSVKGRFTISRDNSKNTLYLQMNSLRAEDTAVYYCAKPGKLFDYWGQGTLVTVSS

SEQ ID NO: 84 - protein, 118 aa, Artificial Sequence
  Description of Artificial Sequence: Synthetic polypeptide
EVQLLESGGGLVQPGGSLRLSCAASGFTFADYEMWWVRQAPGKGLEWVSAISRQGFATYYADSVKGRFTISRDNSKNTLYLQMNSLRAEDTAVYYCAKDLERDDFDYWGQGTLVTVSS

SEQ ID NO: 85 - protein, 120 aa, Artificial Sequence
  Description of Artificial Sequence: Synthetic polypeptide
EVQLLESGGGLVQPGGSLRLSCAASGFTFANYEMGWARQAPGKGLEWVSVISEWGYSTYYADSAKGRFTISRDNSKNTLYLQMNSLRAEDTAVYYCAKLVGGTQYEFDYWGQGTLVTVSS

SEQ ID NO: 86 - protein, 116 aa, Artificial Sequence
  Description of Artificial Sequence: Synthetic polypeptide
EVQLLESGGGLVQPGGSLRLSCAASGFTFHNYEMSWVRQAPGKGLEWVSSISSGGSSTYYADSVKGRFTISRDNSKNTLYLQMNSLRAEDTAVYYCAKPGVKFDYWGQGTLVTVSS

SEQ ID NO: 87 - protein, 116 aa, Artificial Sequence
  Description of Artificial Sequence: Synthetic polypeptide
EVQLLESGGGLVQPGGSLRLSCAASGFTFGLYEMTWVRQAPGKGLEWVSSITGDGISTYYADSVKGRFTISRDNSRNTLYLQMNSLRAEDTAVYYCAKAGRKFDYWGQGTLVTVSS

SEQ ID NO: 88 - protein, 116 aa, Artificial Sequence
  Description of Artificial Sequence: Synthetic polypeptide
EVQLLESGGGLVQPGGSLRLSCAASGFTFSNYQMAWVRQAPGKGLEWVSSITSEGGSTYYADSVKGRFTISRDNSKNTLYLQMNSLRAEDTAVYYCAKPGKNFDYWGQGTLVTVSS

SEQ ID NO: 89 - protein, 116 aa, Artificial Sequence
  Description of Artificial Sequence: Synthetic polypeptide
EVQLLESGGGLVQPGGSLRLSCAASGFTFSDYQMAWVRQAPGKGLEWVSSITSEGGSTYYADSVKGRFTISRDNSKNTVYLQMNSLRAEDTAVYYCAKPGKNFDYWGQGTLVTVSS

SEQ ID NO: 90 - protein, 116 aa, Artificial Sequence
  Description of Artificial Sequence: Synthetic polypeptide
EVQLLESGGGLVQPGGSLRLSCAASGFTFDNYEMTWVRQAPGKGLEWVSTITSQGTSTYYADSVKGRFTISRDNSKNTLYLQMNSLRAEDTAVYYCAKPDRSFDYWGQGTLVTVSS

SEQ ID NO: 91 - protein, 116 aa, Artificial Sequence
  Description of Artificial Sequence: Synthetic polypeptide
EVQLLESGGGLVQPGGSLRLSCAASGFTFRSYEMTWVRQAPGKGLEWVSSITSDGGTTYYADSVKGRFTISRDNSKNTLYLQMNSLRAEDTAVYYCAKPDKTFDYWGQGTLVTVSS

SEQ ID NO: 92 - protein, 116 aa, Artificial Sequence
  Description of Artificial Sequence: Synthetic polypeptide
EVQLLESGGGLVQPGGSLRLSCAASGFTFNLYEMTWVRQAPGKGLEWVSSITSDGVSTYYADSVKGRFTISRDNSKNTLYLQMNSLRAEDTAVYYCAKPDSPFDYWGQGTLVTVSS

SEQ ID NO: 93 - protein, 116 aa, Artificial Sequence
  Description of Artificial Sequence: Synthetic polypeptide
EVQLLESGGGLVQPGGSLRLSCAASGFTFGHYDMAWVRQAPGKGLEWVSTISDNGNGTYYADSVKGRFTISRDNSKNTLYLQMNSLRAEDTAVYYCAKPGRDFDYWGQGTLVTVSS

SEQ ID NO: 94 - protein, 116 aa, Artificial Sequence
  Description of Artificial Sequence: Synthetic polypeptide
EVQLLESGGGLVQPGGSLRLSCAASGFTFGRYQMAWVRQAPGKGLEWVSSISSDGGGTYYADSVKGRFTISRDNSKNTLYLQMNSLRAEDTAVYYCAKPGRAFDYWGQGTLVTVSS

SEQ ID NO: 95 - protein, 116 aa, Artificial Sequence
  Description of Artificial Sequence: Synthetic polypeptide
EVQLLESGGGLVQPGGSLRLSCAASGFTFARYQMAWVRQAPGKGLEWVSTISDDGDSTYYADSVKGRFTISRDNSKNTLYLQMNSLRAEDTAVYYCAKLDKLFDYWGQGTLVTVSS

SEQ ID NO: 96 - protein, 116 aa, Artificial Sequence
  Description of Artificial Sequence: Synthetic polypeptide
EVQLLESGGGLVQPGGSLRLSCAASGFTFDNDEMTWVRQAPGKGLEWVSAIDTTGGQTYYADSVKGRFTISRDNSKNTLYLQMNSLRAEDTAVYYCAKPGKEFDYWGQGTLVTVSS

SEQ ID NO: 97 - protein, 116 aa, Artificial Sequence
  Description of Artificial Sequence: Synthetic polypeptide
EVQLLESGGGLVQPGGSLRLSCAASGFTFGESEMSWVRQAPGKGLEWVSSILDEGSGTYYADSVKGRFTISRDNSKNTLYLQMNSLRAEDTAVYYCAKPDKDFDYWGQGTLVTVSS

SEQ ID NO: 98 - protein, 117 aa, Artificial Sequence
  Description of Artificial Sequence: Synthetic polypeptide
EVQLLESGGGLVQPGGSLRLSCAASGFTFGEEEMSWVRQAPGKGLEWVSAITDDGDDTYYADSVKGRFTISRDNSKNTLYLQMNSLRAEDTAVYYCAKPNAGAFDYWGQGTLVTVSS

SEQ ID NO: 99 - protein, 116 aa, Artificial Sequence
  Description of Artificial Sequence: Synthetic polypeptide
EVQLLESGGGLVQPGGSLRLSCAASGFTFEVYDMAWVRQAPGKGLEWVSGIVNDGSSTYYADSVKGRFTISRDNSKNTLYLQMNSLRAEDTAVYYCAKPDKDFDYWGQGTLVTVSS

SEQ ID NO: 100 - protein, 116 aa, Artificial Sequence
  Description of Artificial Sequence: Synthetic polypeptide
EVQLLESGGGLVQPGGSLRLSCAASGFTFGNTEMTWVRQAPGKGLEWVSSIADDGSSTYYADSVKGRFTISRDNSKNTLYLQMNSLRAEDTAVYYCAKPGQAFDYWGQGTLVTVSS

SEQ ID NO: 101 - protein, 116 aa, Artificial Sequence
  Description of Artificial Sequence: Synthetic polypeptide
EVQLLESGGGLVQPGGSLRLSCAASGFTFEEYQMAWVRQAPGKGLEWVSTISDDGSSTYYADSVKGRFTISRDNSKNTLYLQMNSLRAEDTAVYYCAKPDLYFDYWGQGTLVTVSS

SEQ ID NO: 102 - protein, 116 aa, Artificial Sequence
  Description of Artificial Sequence: Synthetic polypeptide
EVQLLESGGGLVQPGGSLRLSCAASGFTFEVYQMGWVRQAPGKGLEWVSFIVPGGDLTYYADSVKGRFTISRDNSKNTLYLQMNSLRAEDTAVYYCAETWPEFDYWGQGTLVTVSS

SEQ ID NO: 103 - protein, 116 aa, Artificial Sequence
  Description of Artificial Sequence: Synthetic polypeptide
EVQLLESGGGLVQPGGSLRLSCAASGFTFDNYEMTWVRQAPGKGLEWVSSITSDGTSTYYADSVKGRFTISRDNSKNTLYLQMNSLRAEDTAVYYCAKPNPPFDYWGQGTLVTVSS

SEQ ID NO: 104 - protein, 119 aa, Artificial Sequence
  Description of Artificial Sequence: Synthetic polypeptide
EVQLLESGGGLVQPGGSLRLSCAASGFTFKAYDMGWVRQAPGKGLEWVSQIGRDGSFTYYADSVKGRFTISRDNSKNTLYLQMNSLRAEDTAVYYCAKPRRYAIFTFDRGQGTLVTVSS

SEQ ID NO: 105 - protein, 121 aa, Artificial Sequence
  Description of Artificial Sequence: Synthetic polypeptide
EVQLLESGGGLVQPGGSLRLSCAASGFTFKQYPMVWVRQAPGKGLEWVSTISTNGVRTYYADSVKGRFTISRDNSKNTLYLQMNSLRAEDTAVYYCAKWTDIISSSEFDYWGQGTLVTVSS

SEQ ID NO: 106 - protein, 123 aa, Artificial Sequence
  Description of Artificial Sequence: Synthetic polypeptide
EVQLLESGGGLVQPGGSLRLSCAASGFTFFNYDMSWVRQAPGKGLEWVSAISGSGGSTYYADSVKGRFTISRDNSKNTLYLQMNSLRAEDTAVYYCAKVFVWSADIDFDFDYWGQGTLVTVSS

SEQ ID NO: 107 - protein, 123 aa, Artificial Sequence
  Description of Artificial Sequence: Synthetic polypeptide
EVQLLESGGGLVQPGGSLRLSCAASGFTFSWYDMSWVRQAPGKGLEWVSHIASWGGKTYYADSVKGRFTISRDNSKNTLYLQMNSLRAEDTAVYYCAKVTVKDGGYLMDFDYWGQGTLVTVSS

SEQ ID NO: 108 - protein, 122 aa, Artificial Sequence
  Description of Artificial Sequence: Synthetic polypeptide
EVQLLESGGGLVQPGGSLRLSCAASGFTFAEYAMAWVRQAPGKGLEWVSSIGRDGAVTYYADSVKGRFTISRDNSKNTLYLQMNSLRAEDTAVYYCAKWKAAKERGSWFDYWGQGTLVTVSS

SEQ ID NO: 109 - protein, 116 aa, Artificial Sequence
  Description of Artificial Sequence: Synthetic polypeptide
EVQLLESGGGLVQPGGSLRLSCAASGFTFQAYQMQWVRQAPGKGLEWVSTISPNGLFTYYADSVKGRFTISRDNSKNTLYLQMNSLRAEDTAVYYCAKWLSSFDYWGQGTLVTVSS

SEQ ID NO: 110 - protein, 120 aa, Artificial Sequence
  Description of Artificial Sequence: Synthetic polypeptide
EVQLLESGGGLVQPGGSLRLSCAASGFTFAMYSMAWVRQAPGKGLEWVSGISPRGVETYYADSVKGRFTISRDNSKNTLYLQMNSLRAEDTAVYYCAKTNWNGVDLFDYWGQGTLVTVSS

SEQ ID NO: 111 - protein, 119 aa, Artificial Sequence
  Description of Artificial Sequence: Synthetic polypeptide
EVQLLESGGGLVQPGGSLRLSCAASGFTFPTYMMSWVRQAPGKGLEWVSTINTNGRDTYYADSVKGRFTISRDNSKNTLYLQMNSLRAEDTAVYYCAKGDSNMSFFDYWGQGTLVTVSS

SEQ ID NO: 112 - protein, 120 aa, Artificial Sequence
  Description of Artificial Sequence: Synthetic polypeptide
EVQLLESGGGLVQPGGSLRLSCAASGFTFEGYSMTWVRQAPGKGLEWVSSINASGTLTYYADSVKGRFTISRDNSKNTLYLQMNSLRAEDTAVYYCAKDGNRSEVFFDYWGQGTLVTVSS

SEQ ID NO: 113 - protein, 116 aa, Artificial Sequence
  Description of Artificial Sequence: Synthetic polypeptide
EVQLLESGGGLVQPGGSLRLSCAASGFTFFEYEMTWVRQAPGKGLEWVSSIANDGSTTYYADSVKGRFTISRDNSKNTLYLQMNSLRAEDTAVYYCAKPDRQFDYWGQGTLVTVSS

SEQ ID NO: 114 - protein, 116 aa, Artificial Sequence
  Description of Artificial Sequence: Synthetic polypeptide
EVQLLESGGGLVQPGGSLRLSCAASGFTFQDYLMAWVRQAPGKGLEWVSEINQDGTVTYYADSVKGRFTISRDNSKNTLYLQMNSLRAEDTAVYYCAESSPYFDYWGQGTLVTVSS

SEQ ID NO: 115 - protein, 123 aa, Artificial Sequence
  Description of Artificial Sequence: Synthetic polypeptide
EVQLLESGGGLVQPGGSLRLSCAASGFTFDNYAMSWVRQAPGKGLEWVSSISRDGHVTYYADSVKGRFTISRDNSKNTLYLQMNSLRAEDTAVYYCAKLSSKGGTFASSFDYWGQGTLVTVSS

SEQ ID NO: 116 - protein, 119 aa, Artificial Sequence
  Description of Artificial Sequence: Synthetic polypeptide
EVQLLESGGGLVQPGGSLRLSCAASGFTFSAVPMTWVRQAPGKGLEWVSAITDDGLRTYYADSVKGRFTISRDNSKNTLYLQMNSLRAEDTAVYYCAKGHIYGDYFDYWGQGTLVTVSS

SEQ ID NO: 117 - protein, 123 aa, Artificial Sequence
  Description of Artificial Sequence: Synthetic polypeptide
EVQLLESGGGLVQPGGSLRLSCAASGFTFELYRMMWVRQAPGKGLEWVSAISSDGDTTYYADSVKGRFTISRDNSKNTLYLQMNSLRAEDTAVYYCAEHWLGTTLSLRDFDYWGQGTLVTVSS

SEQ ID NO: 118 - protein, 123 aa, Artificial Sequence
  Description of Artificial Sequence: Synthetic polypeptide
EVQLLESGGGLVQPGGSLRLSCAASGFTFYRYTMAWVRQAPGKGLEWVSQISPRGNITYYADSVKGRFTISRDNSKNTLYLQMNSLRAEDTAVYYCAKSGVAGAESPEYFDYWGQGTLVTVSS

SEQ ID NO: 119 - protein, 119 aa, Artificial Sequence
  Description of Artificial Sequence: Synthetic polypeptide
EVQLLESGGGLVQPGGSLRLSCAASGFTFLGYYMSWIRQAPGKGLEWVSTIGPIGGGTYYADSVKGRFTISRDNSKNTLYLQMNSLRAEDTAVYYCAKSQNIYGPFDYWGQGTLVTVSS

SEQ ID NO: 120 - protein, 116 aa, Artificial Sequence
  Description of Artificial Sequence: Synthetic polypeptide
EVQLLESGGGLVQPGGSLRLSCAASGFTFEQYDMAWVRQAPGKGLEWVSEISRDGGRTYYADSVKGRFTISRDNSKNTLYLQMNSLRAEDTAVYYCAEEYPYFDYWGQGTLVTVSS

SEQ ID NO: 121 - protein, 121 aa, Artificial Sequence
  Description of Artificial Sequence: Synthetic polypeptide
EVQLLESGGGLVQPGGSLRLSCAASGFTFPQYSMVWVRQAPGKGLEWVSTISPLGSSTYYADSVKGRFTISRDNSKNTLYLQMNSLRAEDTAVYYCAKMSKLLLSREFDYWGQGTLVTVSS

SEQ ID NO: 122 - protein, 120 aa, Artificial Sequence; identical to SEQ ID NO: 110
  Description of Artificial Sequence: Synthetic polypeptide

SEQ ID NO: 123 - protein, 119 aa, Artificial Sequence
  Description of Artificial Sequence: Synthetic polypeptide
EVQLLESGGGLVQPGGSLRLSCAASGFTFTRHGMAWVRQAPGKGLEWVSTITPTGNTTYYADSVKGRFTISRDNSKNTLYLQMNSLRAEDTAVYYCAKDAHDEGYFDYWGQGTLVTVSS

SEQ ID NO: 124 - protein, 116 aa, Artificial Sequence
  Description of Artificial Sequence: Synthetic polypeptide
EVQLLESGGGLVQPGGSLRLSCAASGFTFGPYEMTWVRQAPGKGLEWVSSIVGDGLDTYYADSVKGRFTISRDNSKNTLYLQMNSLRAEDTAVYYCAKPDRVFDYWGQGTLVTVSS

SEQ ID NO: 125 - protein, 114 aa, Artificial Sequence
  Description of Artificial Sequence: Synthetic polypeptide
EVQLLESGGGLVQPGGSLRLSCAASGFTFGSTPMMWVRQAPGKGLEWVSEIRDTGLATYYADSVKGRFTISRDNSKNTLYLQMNSLRAEDTAVYYCASVSFDYWGQGTLVTVSS

SEQ ID NO: 126 - protein, 118 aa, Artificial Sequence
  Description of Artificial Sequence: Synthetic polypeptide
EVQLLESGGGLVQPGGSLRLSCAASGFTFHLGDMHWVRQAPGKGLEWVSSISGTGHTTYYADSVKGRFTISRDNSKNTLYLQMNSLRAEDTAVYYCAKPMNDQGFDYWGQGTLVTVSS

SEQ ID NO: 127 - protein, 116 aa, Artificial Sequence
  Description of Artificial Sequence: Synthetic polypeptide
EVQLLESGGGLVQPGGSLRLSCAASGFTFMDEDMLWVRQAPGKGLEWVSRINSLGTHTYYADSVKGRFTISRDNSKNTLYLQMNSLRAEDTAVYYCAKSFMMFDYWGQGTLVTVSS

SEQ ID NO: 128 - protein, 116 aa, Artificial Sequence
  Description of Artificial Sequence: Synthetic polypeptide
EVQLLESGGGLVQPGGSLRLSCAASGFTFRNYQMHWVRQAPGKGLEWVSGIDATGRATYYADSVKGRFTISRDNSKNTLYLQMNSLRAEDTAVYYCARSTRSFDYWGQGTLVTVSS

SEQ ID NO: 129 - protein, 118 aa, Artificial Sequence
  Description of Artificial Sequence: Synthetic polypeptide
EVQLLESGGGLVQPGGSLRLSCAASGFTFTNADMVWVRQAPGKGLEWVSSISGSGGSTYYADSVKGRFTISRDNSKNTLYLQMNSLRAEDTAVYYCAKGYLTSHFDYWGQGTLVTVSS

SEQ ID NO: 130 - protein, 120 aa, Artificial Sequence
  Description of Artificial Sequence: Synthetic polypeptide
EVQLLESGGGLVQPGGSLRLSCAASGFTFRDYSMAWVRQAPGKGLEWVSTITPSGLTTYYADSVKGRFTISRDNSKNTLYLQMNSLRAEDTAVYYCAEWSQAVTRSFDYWGQGTLVTVSS

SEQ ID NO: 131 - protein, 116 aa, Artificial Sequence
  Description of Artificial Sequence: Synthetic polypeptide
EVQLLESGGDLVQPGGSLRLSCAASGFTFSDEGMMWVRQAPGKGLEWVSEINQQGSATYYADSVKGRFTISRDNSKNTLYLQMNSLRAEDTAVYYCAKTIGMFDYWGQGTLVTVSS

SEQ ID NO: 132 - protein, 123 aa, Artificial Sequence
  Description of Artificial Sequence: Synthetic polypeptide
EVQLLESGGGLVQPGGSLRLSCAASGFTFTDQPMVWVRQAPGKGLEWVSSIGARGGPTYYADSVKGRFTVSRDNSKNTLYLQMNSLRAEDTAVYYCAKWFDIIAWDPFSFDYWGQGTLVTVSS

SEQ ID NO: 133 - protein, 119 aa, Artificial Sequence
  Description of Artificial Sequence: Synthetic polypeptide
EVQLLESGGGLVQPGGSLRLSCAASGFTFNQYPMMWVRQAPGKGLEWVSSITPSGFLTYYADSVKGRFTISRDNSKNTLYLQMNSLRAEDTAVYYCAEWNPFITTFDYWGQGTLVTVSS

SEQ ID NO: 134 - protein, 118 aa, Artificial Sequence
  Description of Artificial Sequence: Synthetic polypeptide
EVQLLESGGGLVQPGGSLRLSCAASGFTFGHQQMAWVRQAPGKGLEWVSTITPNGYYTYYADSVKGRFTISRDNSKNTLYLQMNSLRAEDTAVYYCAKFDYSLRFDYWGQGTLVTVSS

SEQ ID NO: 135 - protein, 116 aa, Artificial Sequence
  Description of Artificial Sequence: Synthetic polypeptide
EVQLLESGGGLVQPGGSLRLSCAASGFTFASYEMAWVRQAPGKGLEWVSSIGSDGGPTYYADSVKGRFTISRDNSKNTLYLQMNSLRAEDSAVYYCAKPDRAFDYWGQGTLVTVSS

SEQ ID NO: 136 - protein, 124 aa, Artificial Sequence
  Description of Artificial Sequence: Synthetic polypeptide
EVQLLESGGGLVQPGGSLRLSCAASGFTFSAEQMTWARQAPGKGLEWVSTITPHGDSTYYADSVKGRFTISRDNSKNTLYLQMNSLRAEDTAVYYCAKWRTLVDWPTSESFDYWGQGTLVTVSS

SEQ ID NO: 137 - protein, 119 aa, Artificial Sequence
  Description of Artificial Sequence: Synthetic polypeptide
EVQLLESGGGLVQPGGSLRLSCAASGFTFTSYEMGWVRQAPGKGLEWVSSIEPTGITTYYADSVKGRFTISRDNSKNTLYLQMNSLRAEDTAVYYCAKPHFTELGFDYWGQGTLVTVSS

SEQ ID NO: 138 - protein, 117 aa, Artificial Sequence
  Description of Artificial Sequence: Synthetic polypeptide
EVQLLESGGGLVQPGGSLRLSCAASGFTFEGEQMAWVRQAPGKGLEWVSTITLPGPYTFYADSVKGRFTISRDNSKNTLYLQMNSLRAEDTAVYYCAKGNGTFFDYWGQGTLVTVSS

SEQ ID NO: 139 - protein, 120 aa, Artificial Sequence
  Description of Artificial Sequence: Synthetic polypeptide
EVQLLESGGGLVQPGGSLRLSCAASGFTFGNYAMAWVRQAPGKGLEWVSKIGAQGLHTYYAGSVKGRFTISRDNSKNTLYLQMNSLRAEDTAVYYCAKQTTMDYERFDYWGQGTLVTVSS

SEQ ID NO: 140 - protein, 121 aa, Artificial Sequence
  Description of Artificial Sequence: Synthetic polypeptide
EVQLLESGGGLVQPGGSLRLSCAASGFTFDEVDMSWVRQAPGKGLEWVSAIGNNGLKTYYADSVKGRFTISRDNSKNTLYLQMNSLRAEDTAVYYCAKSALSYRPPVFDYWGQGTLVTVSS

SEQ ID NO: 141 - protein, 118 aa, Artificial Sequence
  Description of Artificial Sequence: Synthetic polypeptide
EVQLLESGGGLVQPGGSLRLSCAASGFTFQDDTMSWVRQAPGKGLEWVSTITLKGPSTYYADSVKGRFTISRDNSKNTLYLQMNSLRAEDTAVYYCAKSRDGLYFDYWGQGTLVTVSS

SEQ ID NO: 142 - protein, 118 aa, Artificial Sequence
  Description of Artificial Sequence: Synthetic polypeptide
EVQLLESGGGLVQPGGSLRLSCAASGFTFASSPMAWVRQAPGKGLEWVSSIGRDGSTTYYADSVKGRFTISRDNSKNTLYLQMNSLRAEDTAVYYCAKPSPYRRFDYWGQGTLVTVSS

SEQ ID NO: 143 - protein, 120 aa, Artificial Sequence
  Description of Artificial Sequence: Synthetic polypeptide
EVQLLESGGGLVQPGGSLRLSCAASGFTFTDYSMVWVRQAPGKGLEWVSTIVSHGGTTYYADSVKGRFTISRDNSKNTLYLQMNSLRAEDTAVYYCAKGKGYNAQYFDYWGQGTLVTVSS

SEQ ID NO: 144 - protein, 118 aa, Artificial Sequence; identical to SEQ ID NO: 134
  Description of Artificial Sequence: Synthetic polypeptide

SEQ ID NO: 145 - protein, 116 aa, Artificial Sequence
  Description of Artificial Sequence: Synthetic polypeptide
EVQLLESGGGLVQPGGSLRLSCAASGFTFNDYDMIWVRQAPGKGLEWVSTISSHGDSTYYADSVKGRFTISRDNSKNTLYLQMNSLRAEDTAVYYCAKGDVFFDYWGQGTLVTVSS

SEQ ID NO: 146 - protein, 116 aa, Artificial Sequence
  Description of Artificial Sequence: Synthetic polypeptide
EVQLLESGGGLVQPGGSLRLSCAASGFTFGHQQMAWVRQAPGKGLEWVSTITPNGYYTYYADSVKGRFTISRDNSKNTLYLQMNSLRAEDTAVYYCAEWSDSFDYRGQGTLVTVSS

SEQ ID NO: 147 - protein, 119 aa, Artificial Sequence
  Description of Artificial Sequence: Synthetic polypeptide
EVQLLESGGGLVQPGGSLRLSCAASGFTFADYEMAWVRQAPGKGLEWVSGIQSNGNITYYADSVKGRFTISRDNSKNTLYLQMNSLRAEDTAVYYCAKANSQVEYFDYWGQGTLVTVSS

SEQ ID NO: 148 - protein, 118 aa, Artificial Sequence
  Description of Artificial Sequence: Synthetic polypeptide
EVQLLESGGGLVQPGGSLRLSCAASGFTFGVEPMSWVRQAPGKGLEWVSNIGRDGSMTYYADSVKGRFTISRDNSKNTLYLQMNSLRAEDTAVYYCAKLGKHGTFDYWGQGTLVTVSS

SEQ ID NO: 149 - protein, 119 aa, Artificial Sequence
  Description of Artificial Sequence: Synthetic polypeptide
EVQLLESGGGLVQPGGSLRLSCAASGFTFPEYRMMWVRQAPGKGLEWVSWIDERGSLTYYADSVKGRFTISRDNSKNTLYLQMNSLRAEDTAVYYCAKRRKGTKQFDYWGQGTLVTVSS

SEQ ID NO: 150 - protein, 122 aa, Artificial Sequence
  Description of Artificial Sequence: Synthetic polypeptide
EVQLLESGGGLVQPGGSLRLSCAASGFTFELYAMAWVRQAPGKGLEWVSGIGAVGETTYYADSVKGRFTISRDNSKNTLYLQMNSLRAEDTAVYYCAKEANNLSDNLVFDYWGQGTLVTVSS

SEQ ID NO: 151 - protein, 117 aa, Artificial Sequence
  Description of Artificial Sequence: Synthetic polypeptide
EVQLLESGGGLVQPGGSLRLSCAASGFTFGHQQMAWVRQAPGKGLEWVSTITPNGYYTYYADSVKGRFTISRDNSKNTLYLQMNSLRAEDTAVYYCAKWSVEWFDYWGQGTLVTVSS

SEQ ID NO: 152 - protein, 116 aa, Artificial Sequence
  Description of Artificial Sequence: Synthetic polypeptide
EVQLLESGGGLVQPGGSLRLSCAASGFTFNSYTMNWVRQAPGKGLEWVSSINPWGSRTYYADSVKGRFTISRDNSKNTLYLQMNSLRAEDTAVYYCAKGLVLFDYWGQGTLVTVSS

SEQ ID NO: 153 - protein, 119 aa, Artificial Sequence
  Description of Artificial Sequence: Synthetic polypeptide
EVQLLESGGGLVQPGGSLRLSCAASGFTFDGDMMSWVRQAPGKGLEWVSSITQLGSRTYYADSVKGRFTISRDNSKNTLYLQMNSLRAEDTAVYYCAKQNWRTLTFDYWGQGTLVTVSS

SEQ ID NO: 154 - protein, 119 aa, Artificial Sequence
  Description of Artificial Sequence: Synthetic polypeptide
EVQLLESGGGLVQPGGSLRLSCAASGFTFNAYGMMWVRQAPGKGLEWVSSILSDGVITYYADSVKGRFTISRDNSKNTLYLQMNSLRAEDTAVYYCAKSARGANFFDYWGQGTLVTVSS

SEQ ID NO: 155 - protein, 120 aa, Artificial Sequence
  Description of Artificial Sequence: Synthetic polypeptide
EVQLLESGGGLVQPGGSLRLSCAASGFTFGHYMMVWVRQAPGKGLEWVSSITPHGTSTYYADSVKGRFTISRDNSKNTLYLQMNSLRAEDTAVYYCAEFNAIFSEAFDYWGQGTLVTVSS

SEQ ID NO: 156 - protein, 120 aa, Artificial Sequence; identical to SEQ ID NO: 130
  Description of Artificial Sequence: Synthetic polypeptide

SEQ ID NO: 157 - protein, 120 aa, Artificial Sequence
  Description of Artificial Sequence: Synthetic polypeptide
EVQLLESGGGLVQPGGSLRLSCAASGFTFDLYAMAWVRQAPGKGLEWVSMIGRDGRFTYYADSVKGRFTISRDNSKNTLYLQMNSLRAEDTAVYYCAKLAGSLRGRFDYWGQGTLVTVSS

SEQ ID NO: 158 - protein, 118 aa, Artificial Sequence
  Description of Artificial Sequence: Synthetic polypeptide
EVQLLESGGGLVQPGGSLRLSCAASGFTFNKASMGWVRQAPGKGLEWVSTITPHGSSTYYADSVKGRFTISRDNSKNTLYLQMNSLRAEDTAVYYCAKQRWGVEFDYWGQGTLVTVSS

SEQ ID NO: 159 - protein, 120 aa, Artificial Sequence
  Description of Artificial Sequence: Synthetic polypeptide
EVQLLESGGGLVQPGGSLRLSCAASGFTFQGYSMGWVRQAPGKGLEWVSSIAGRGGVTYYADSVKGRFTISRDNSKNTLYLQMNSLRAEDTAVYYCAKGLYIYHSLFDYWGQGTLVTVSS

SEQ ID NO: 160 - protein, 116 aa, Artificial Sequence
  Description of Artificial Sequence: Synthetic polypeptide
EVQLLESGGGLVQPGGSLRLSCAASGFTFPGMEMSWVRQAPGKGLEWVSAITGTGSTTYYADSVKGRFTISRDNSKNTLYLQMNSLRAEDTAVYYCAKGYHPFDYWGQGTLVTVSS

SEQ ID NO: 161 - protein, 117 aa, Artificial Sequence
  Description of Artificial Sequence: Synthetic polypeptide
EVQLLESGGGLVQPGGSLRLSCAASGFTFPMVAMSWVRQAPGKGLEWVSSIARDGNVTYYADSVKGRFTISRDNSKNTLYLQMNSLRAEDAAVYYCAKVSPTGFDYWGQGTLVTVSS

SEQ ID NO: 162 - protein, 116 aa, Artificial Sequence
  Description of Artificial Sequence: Synthetic polypeptide
EVQLLESGGGLVQPGGSLRLSCAASGFTFGHQDMSWVRQAPGKGLEWVSGITDDGESTYYADSVKGRFTISRDNSKNTLYLQMNSLRAEDTAVYYCAKGDYDFDYWGQGTLVTVSS

SEQ ID NO: 163 - protein, 117 aa, Artificial Sequence
  Description of Artificial Sequence: Synthetic polypeptide
EVQLLESGGGLVQPGGSLRLSCAASGFTFGEYNMMWVRQAPGKGLEWVSQITRDGSRTYYADSVRGRFTISRDNSRNTLYLQMNSLRAEDSAVYYCAKLSNIGFDYWGQGTLVTVSS

SEQ ID NO: 164 - protein, 116 aa, Artificial Sequence
  Description of Artificial Sequence: Synthetic polypeptide
EVQLLESGGGLVQPGGSLRLSCAASGFTFSDYSMIWARQAPGKGLEWVSSITPYGSYTYYADSVKGRFTISRDNSKNTLYLQMNSLRAEDTAVYYCAKTDYLFDYWGQGTLVTVSS

SEQ ID NO: 165 - protein, 116 aa, Artificial Sequence
  Description of Artificial Sequence: Synthetic polypeptide
EVQLLESGGGLVQPGGSLRLSCAASGFTFDTYSMMWVRQAPGKGLEWVSTITPYGSSTYYADSVKGRFTISRDNSKNTLYLQMNSLRAEDTAVYYCAKWGLVFDYWGQGTLVTVSS

SEQ ID NO: 166 - protein, 118 aa, Artificial Sequence
  Description of Artificial Sequence: Synthetic polypeptide
EVQLLESGGGLVQPGGSLRLSCAASGFTFTTGPMMWVRQAPGKGLEWVSAIGIGGDTTYYADSVKGRFTISRDNSKNTLYLQMNSLRAEDTAVYYCAKLTPSNQFDYWGQGTLVTVSS

SEQ ID NO: 167 - protein, 119 aa, Artificial Sequence
  Description of Artificial Sequence: Synthetic polypeptide
EVQLLESGGGLVQPGGSLRLSCAASGFTFKQYQMMWVRQAPGKGLEWVSSITPSGFLTYYADSVKGRFTISRDNSKNTLYLQMNSLRAEDTAVYYCAEWNPFISTFDYWGQGTLVTVSS

SEQ ID NO: 168 - protein, 120 aa, Artificial Sequence
  Description of Artificial Sequence: Synthetic polypeptide
EVQLLESGGGLVQPGGSLRLSCAASGFTFPNYDMVWVRQAPGKGLEWVSSISALGNVTYYADSVKGRFTISRDNSKNTLYLQTNSLRAEDTAVYYCAKWRSAITGNFDYWGQGTLVTVSS

SEQ ID NO: 169 - protein, 123 aa, Artificial Sequence
  Description of Artificial Sequence: Synthetic polypeptide
EVQLLESGGGLVQPGGSLRLSCAASGFTFKEYQMSWVRQAPGKGLEWVSTISPSGMNTYYADSVKGRFTISRDNSKNTLYLQMNSLRAEDTAVYYCAEWRSVVRPWPGVFDYWGQGTLVTVSS

SEQ ID NO: 170 - protein, 121 aa, Artificial Sequence
  Description of Artificial Sequence: Synthetic polypeptide
EVQLLESGGGLVQPGGSLRLSCAASGFTFDDESMAWVRQAPGKGLEWVSSITPHGTFTYYADSVKGRFTISRDNSKNTLYLQMNSLRAEDTAVYYCAKLHLKLYESHFDYWGQGTLVTVSS

SEQ ID NO: 171 - protein, 116 aa, Artificial Sequence
  Description of Artificial Sequence: Synthetic polypeptide
EVQLLESGGGLVQPGGSLRLSCAASGFTFEGGEMGWVRQAPGKGLEWVSMIPMDGSATYYADSVKGRFTISRDNSKNTLYLQMNSLRAEDTAVYYCAKAGSTFDYWGQGTLVTVSS

SEQ ID NO: 172 - protein, 118 aa, Artificial Sequence
  Description of Artificial Sequence: Synthetic polypeptide
EVQLLESGGGLVQPGGSLRLSCAASGFTFDFMPMAWVRQAPGKGLEWVSSIGRDGAYTYYADSVKGRFTISRDNSKNTLYLQMNSLRAEDTAVYYCAKLASPAQFDYWGQGTLVTVSS

SEQ ID NO: 173 - protein, 121 aa, Artificial Sequence
  Description of Artificial Sequence: Synthetic polypeptide
EVQLLESGGGLVQPGGSLRLSCAASGFTFGDEPMLWVRQAPGKGLEWVSSIGGTGTTTYYADSVKGRFTISRDNSKNTLYLQMNSLRAEDTAVYYCAKGNQGDFINRFHYWGQGTLVTVSS

SEQ ID NO: 174 - protein, 119 aa, Artificial Sequence
  Description of Artificial Sequence: Synthetic polypeptide
EVQLLESGGGLVQPGGSLRLSCAASGFTFHAYNMAWVRQAPGKGLEWVSTISPRGSYTYYADSVKGRFTISRDNSKNTLYLQMNSLRAEDTAVYYCAKWPPPSSHFDYWGQGTLVTVSS

SEQ ID NO: 175 - protein, 116 aa, Artificial Sequence
  Description of Artificial Sequence: Synthetic polypeptide
EVQLLESGGGLVQPGGSLRLSCAASGFTFDGYEMAWVRQAPGKGLEWVSSITSDGTSTYYADSVKGRFTISRDNSKNTLYLQMNSLRAEDTAVYYCAKPGLRFDYWGQGTLVTVSS

SEQ ID NO: 176 - protein, 119 aa, Artificial Sequence
  Description of Artificial Sequence: Synthetic polypeptide
EVQLLESGGGLVQPGGSLRLSCAASGFTFEGYMMYWVHQAPGKGLEWVSSISPQGHFTYYADSVKGRFTISRDNSKNTLYLQMNSLRAEDTAVYYCAELRELPRLFDYWGQGTLVTVSS

SEQ ID NO: 177 - protein, 123 aa, Artificial Sequence
  Description of Artificial Sequence: Synthetic polypeptide
EVQLLESGGGLVQPGGSLRLSCAASGFTFSSYAMGWVRQAPGKGLEWVSSIDASGGPTYYADSVKGRFTISRDNSKNTLYLQMNSLRAEDTAVYYCAKANGKKFPFTKYFDYWGQGTLVTVSS

SEQ ID NO: 178 - protein, 123 aa, Artificial Sequence
  Description of Artificial Sequence: Synthetic polypeptide
EVQLLESGGGLVQPGGSLRLSCAASGFTFPSVHMAWVRQAPGKGLEWVSGINLTGVDTYYADSVKGRFTISRDNSKNTLYLQMNSLRAEDTAVYYCAKSATTRQAHPLYFDYWGQGTLVTVSS

SEQ ID NO: 179 - protein, 118 aa, Artificial Sequence
  Description of Artificial Sequence: Synthetic polypeptide
EVQLLESGGGLVQPGGSLRLSCAASGFTFKEGEMYWVRQAPGKGLEWVSTISTNGLTTYYADSVKGRFTISRDNSKNTLYLQMNSLRAEDTAVYYCAKSTRDLGFAYWGQGTLVTVSS

SEQ ID NO: 180 - protein, 116 aa, Artificial Sequence
  Description of Artificial Sequence: Synthetic polypeptide
EVQLLESGGGLVQPGGSLRLSCAASGFTFEEYEMAWARQAPGKGLEWVSFISPRGHFTYYADSVKGRFTISRDNSKNTLYLQMNSLRAEDTAVYYCAKPAKTFDYWGQGTLVTVSS

SEQ ID NO: 181 - protein, 116 aa, Artificial Sequence
  Description of Artificial Sequence: Synthetic polypeptide
EVQLLESGGGLVQPGGSLRLSCAASGFTFDTYEMLWVRQAPGKGLEWVSRISVDGSITYYADSVKGRFTISRDNSKNTLYLQMNSLRAEDTAVYYCAKTRMRFDYWGQGTLVTVSS

SEQ ID NO: 182 - protein, 124 aa, Artificial Sequence
  Description of Artificial Sequence: Synthetic polypeptide
EVQLLESGGGLVQPGGSLRLSCAASGFTFSSYAMSWVRQAPGKGLEWVSNISRDGSKTYYADSVKGRFTISRDNSKNTLYLQMNSLRAEDTAVYYCAEAQSGGLRSGLTTFDYWGQGTLVTVSS

SEQ ID NO: 183 - protein, 119 aa, Artificial Sequence
  Description of Artificial Sequence: Synthetic polypeptide
EVQLLESGGGLVQPGGSLRLSCADSGFTFSSYAMSWVRQAPGKGLEWVSSIGRDGAYTYYADSVKGRFTISRDNSKNTLYLQMNSLRAEDTAVYYCAKAGPKGIAFDYWGQGTLVTVSS

SEQ ID NO: 184 - protein, 116 aa, Artificial Sequence
  Description of Artificial Sequence: Synthetic polypeptide
EVQLLESGGGLVQPGGSLRLSCAASGFTFSPHAMAWVRQAPGKGLEWVSGIDGGGSMTYYADSVKGRFTISRDNSKNTLYLQMNSLRAEDTAVYYCAKSDPPFDYWGQGTLVTVSS

SEQ ID NO: 185 - protein, 118 aa, Artificial Sequence
  Description of Artificial Sequence: Synthetic polypeptide
EVQLLESGGGLVQPGGSLRLSCAASGFTFHAGEMHWVRQAPGKGLEWVSSITLPGDMTYYADSVKGRFTISRDNSKNTLYLQMNSLRAEDTAVYYCAKPNTGYTFDYWGQGTLVTVSS

SEQ ID NO: 186 - protein, 116 aa, Artificial Sequence
  Description of Artificial Sequence: Synthetic polypeptide
EVQLLESGGGLVQPGGSLRLSCAASGFTFGNYGMSWVRQAPGKGLEWVSSISWDGSLTYYADSVKGRFTISRDNSKNTLYLQMNSLRAEDTAVYYCAQNTRLFDYWGQGTLVTVSS

SEQ ID NO: 187 - protein, 116 aa, Artificial Sequence
  Description of Artificial Sequence: Synthetic polypeptide
EVQLLESGGGLVQPGGSLRLSCAASGFTFHDADMLWVRQAPGKGLEWVSGILSPGEDTYYADSVKGRFTISRDNSKNTLYLQMNSLRAEDTAVYYCAKFGLPFDYWGQGTLVTVSS

SEQ ID NO: 188 - protein, 116 aa, Artificial Sequence
  Description of Artificial Sequence: Synthetic polypeptide
EVQLLESGGGLVQPGGSLRLSCAASGFTFRTDQMNWVRQAPGKGLEWVSSISPSGAYTYYADSVKGRFTISRDNSKNTLYLQMNSLRAEDTAVYYCAKGLGAFDYWGQGTLVTVSS

SEQ ID NO: 189 - protein, 120 aa, Artificial Sequence
  Description of Artificial Sequence: Synthetic polypeptide
EVQLLESGGGLVQPGGSLRLSCAASGFIFEQYQMVWVRQAPGKGLEWVSWISPDGTHTYYADSVKGRFTISRDNSKNTLYLQMNSLRAEDTAVYYCAKFSLRKMEKFDYWGQGTLVTVSS

SEQ ID NO: 190 - protein, 116 aa, Artificial Sequence
  Description of Artificial Sequence: Synthetic polypeptide
EVQLLESGGGLVQPGGSLRLSCAASGFTFQDEQMAWVRQAPGKGLEWVSSIASDGMSTYYADSVKGRFTISRDNSKNTLYLQMNSLRAEDTAVYYCAQPGKNFDHWGQGTLVTVSS

SEQ ID NO: 191 - protein, 120 aa, Artificial Sequence
  Description of Artificial Sequence: Synthetic polypeptide
EVQLLESGGGLVQPGGSLRLSCAASGFTFSDYAMSWVRQAPGKGLEWVSSITTGGERTYYADSVKGRFTISRDNSKNTLYLQMNSLRAEDTAVYYCAKRWNLYTESFDYWGQGTLVTVSS

SEQ ID NO: 192 - protein, 117 aa, Artificial Sequence
  Description of Artificial Sequence: Synthetic polypeptide
EVQLLESGGGLVQPGGSLRLSCAASGFTFGGQPMDWVRQAPGKGLEWVSSIAPDGIHTYYADSVKGRFTISRDNSKNTLYLQMNSLRAEDTAVYYCAKNLGQGFDYWGQGTLVTVSS

SEQ ID NO: 193 - protein, 116 aa, Artificial Sequence
  Description of Artificial Sequence: Synthetic polypeptide
EVQLLESGGGLVQPGGSLRLSCAASGFTFERYQMTWVRQAPGKGLEWVSSISPSGTFTYYADSVKGRFTISRDNSKNTLYLQMNSLRAEDTAVYYCAEWKALFDYWGQGTLVTVSS

SEQ ID NO: 194 - protein, 117 aa, Artificial Sequence
  Description of Artificial Sequence: Synthetic polypeptide
EVQLLESGGGLVQPGGSLRLSCAASGFTFPHSTMYWVRQAPGKGLEWVSLILPSGSRTYYADSVKGRFTISRDNSKNTLYLQMNSLRAEDTAVYYCAKFSDERFDYWGQGTLVTVSS

SEQ ID NO: 195 - protein, 117 aa, Artificial Sequence
  Description of Artificial Sequence: Synthetic polypeptide
EVQLSESGGGLVQPGGSLRLSCAASGFTFGDGNMDWVRQAPGKGLEWVSGISSDGVTTYYADSVKGRFTISRDNSKNTLYLQMNSLRAEDTAVYYCAKDRGQGFDYWGQGTLVTVSS

SEQ ID NO: 196 - protein, 116 aa, Artificial Sequence
  Description of Artificial Sequence: Synthetic polypeptide
EVQLLESGGGLVQPGGSLRLSCAASGFTFDDYMMWWVRQAPGKGLEWVSSISPHGVYTYYADSVKGRFTISRDNSKNTLYLQMNSLRAEDTAVYYCAKWLHTFDYWGQGTLVTVSS

SEQ ID NO: 197 - protein, 123 aa, Artificial Sequence
  Description of Artificial Sequence: Synthetic polypeptide
EVQLLESGGGLVQPGGSLRLSCAASGFTFSNYTMAWGRQAPGKGLEWVSFIAGPGNYTYYADSVKGRFTISRDNSKNTLYLQMNSLRAEDTAVYYCAKPGSTATYNNGQFDYWGQGTLVTVSS

SEQ ID NO: 198 - protein, 122 aa, Artificial Sequence
  Description of Artificial Sequence: Synthetic polypeptide
EVQLLESGGGLVQPGGSLRLSCAASGFTFTEYSMVWVRQAPGKGLEWVSSISGSGRVTYYADSVKGRFTISRDNSKNTLYLQMNSLRAEDTAVYYCAKWLKLVRAPNPFDYWGQGTLVTVSS

SEQ ID NO: 199 - protein, 120 aa, Artificial Sequence
  Description of Artificial Sequence: Synthetic polypeptide
EVQLLESGGGLVQPGGSLRLSCAASGFTFSNYQMAWVRQAPGKGLEWVSGISKTGHSTYYADSVKGRFTISRDNSRNTLYLQMNSLRAEDTAVYYCAKASHSLGPLFDYWGQGTLVTVSS

SEQ ID NO: 200 - protein, 123 aa, Artificial Sequence
  Description of Artificial Sequence: Synthetic polypeptide
EVQLLESGGGLVQPGGSLRLSCAASGFTFTAYRMAWVRQAPGKGLEWVSWISPSGSGTYYADSVKGRFTISRDNSKNTLYLQMNSLRAEDTAVYYCAKTLTDSPSGHYEFDYWGQGTLVTVSS

SEQ ID NO: 201 - protein, 123 aa, Artificial Sequence
  Description of Artificial Sequence: Synthetic polypeptide
EVQLLESGGGLVQPGGSLRLSCAASGFTFARYEMGWVRQAPGKGLEWVSRITAQGLGTYYADSVKGRFTISRDNSKNTLYLQMNSLRAEDTAVYYCAKYLTDFSSGHQEFDYWGQGTLVTVSS

SEQ ID NO: 202 - protein, 122 aa, Artificial Sequence
  Description of Artificial Sequence: Synthetic polypeptide
EVQLLESGGGLVQPGGSLRLSCAASGFTFDDYGMSWVRQVPGKGLEWVSGISHNGMLTYYADSVKGRFTISRDNSKNTLYLQMNSLRAEDTAVYYCAKYWPSTSWETDFDYWGQGTLVTVSS

SEQ ID NO: 203 - protein, 117 aa, Artificial Sequence
  Description of Artificial Sequence: Synthetic polypeptide
EVQLLESGGGSVQPGGSLRLSCAASGFTFGNEPMAWVRQAPGKGLEWVSSIEMQGKNTYYADSVKGRFTISRDNSKNTLYLQMNSLRAEDTAVYYCAKDRGQGFDYWGQGTLVTVSS

SEQ ID NO: 204 - protein, 120 aa, Artificial Sequence
  Description of Artificial Sequence: Synthetic polypeptide
EVQLLESGGGLVQPGGSLRLSCAASGFTFGEEEMSWVRQAPGKGLEWVSCIDNLGSPTYYADSVKGRFTISRDNSKNTLYLQMNSLRAEDAAVYYCAKTISHQYDRFDYWGQGTLVTVSS

SEQ ID NO: 205 - protein, 120 aa, Artificial Sequence
  Description of Artificial Sequence: Synthetic polypeptide
EVQLLESGGGLVQPGGSLRLSCAASGFTFGEEEMSWVRQAPGKGLEWVSSIDEGGRWTYYADSVKGRFTISRDNSKNTLYLQMNSLRAEDTAVYYCAKWTPHKQLSFDYWGQGTLVTVSS

SEQ ID NO: 206 - protein, 116 aa, Artificial Sequence
  Description of Artificial Sequence: Synthetic polypeptide
EVQLLESGGGLVQPGGSLRLSCAASGFSFADEYMVWARQAPGKGLEWVSEIDPLGTGTYYADSVKGRFTISRDNSKNTLYLQMNSLRAEDTAVYYCAKYGTAFDYWGQGTLVTVSS

SEQ ID NO: 207 - protein, 119 aa, Artificial Sequence
  Description of Artificial Sequence: Synthetic polypeptide
EVQLLESGGGLVQPGGSLRLSCAASGFTFSTHDMMWVRQAPGKGLEWVSSISDDGISTYYADSVKGRFTISRDNSKNTLYLQMNSLRAEDTAVYYCAKPDMSLIEFDYWGQGTLVTVSS

SEQ ID NO: 208 - protein, 121 aa, Artificial Sequence
  Description of Artificial Sequence: Synthetic polypeptide
EVQLLESGGGLVQPGGSLRLSCAASGFTFDGTPMVWVRQAPGKGLEWVSGISGDGRNTYYADSVKGRFTISRDNSKNTLYLQMNSLRAEDTAVYYCAEPYALTSSKPFDYWGQGTLVTVSS

SEQ ID NO: 209 - protein, 123 aa, Artificial Sequence
  Description of Artificial Sequence: Synthetic polypeptide
EVQLLESGGGLVQPGGSLRLSCAASGFTFNDYTMGWVRQAPGKGLEWVSWIHGTGGQTYYADSVKGRFTISRDNSKNTLYLQMNSLRAEDTAVYYCAKALADRSGGVVEFDYWGQGTLVTVSS

SEQ ID NO: 210 - protein, 120 aa, Artificial Sequence
  Description of Artificial Sequence: Synthetic polypeptide
EVQLLESGGGLVQPGGSLRLSCAASGFTFEAETMAWVRQAPGKGLEWVSCISNDGNTTYYADSVKGRFTISRDNSKNTLYLQMNSLRAEDTAVYYCAKESLISPGLFDYWGQGTLVTVSS

SEQ ID NO: 211 - protein, 119 aa, Artificial Sequence
  Description of Artificial Sequence: Synthetic polypeptide
EVQLLESGGGLVQPGGSLRLSCAASGFTFTGEYMNWVRQAPGKGLEWVSTINETGYMTYYADSVKGRFTISRDNSKNTLYLQMNSLRAEDTAVYYCAKLSTRGVPFDYWGQGTLVTVSS

SEQ ID NO: 212 - protein, 120 aa, Artificial Sequence
  Description of Artificial Sequence: Synthetic polypeptide
EVQLLESGGGLVQPGGSLRLSCAASGFTFRSYDMGWVRQAPGKGLEWVSTISPMGVFTYYADSVKGRFTISRDNSKNTLYLQMNSLRAEDTAVYYCAKSNQHAHDPFDYWGQGTLVTVSS

SEQ ID NO: 213 - protein, 119 aa, Artificial Sequence
  Description of Artificial Sequence: Synthetic polypeptide
EVQLLESGGGLVQPGGSLRLSCAASGFTFSDYDMGWVRQAPGKGLEWVSSISPMGTFTYYADSVKGRFTISRDNSKNTLYLQMNSLRAEDTAVYYCAKAALTEPMFDYWGQGTLVTVSS

SEQ ID NO: 214 - protein, 116 aa, Artificial Sequence
  Description of Artificial Sequence: Synthetic polypeptide
EVQLLESGGGLVQPGGSLRLSCAASGFTFRDYDMGWVRQAPGKGLEWVSTISPLGHFTYYADSVKGRSTISRDNSKNTLYLQMNSLRAEDTAVYYCAKAEEAFDYWGQGTLVTVSS

SEQ ID NO: 215 - protein, 116 aa, Artificial Sequence
  Description of Artificial Sequence: Synthetic polypeptide
EVQLLESGGGLVQPGGSLRLSCAASGFAFPRYGMTWVRQAPGKGLEWVSNIDQFGMKTYYADSVKGRFTISRDNSKNTLYLQMNSLRAEDTAVYYCAEEYASFDYWGQGTLVTVSS

SEQ ID NO: 216 - protein, 119 aa, Artificial Sequence
  Description of Artificial Sequence: Synthetic polypeptide
EVQLLESGGGLVQPGGSLRLSCAASGFTFDKYDMGWVRQAPGKGLEWVSTISPMGVFTYYADSVKGRFTISRDNSKNTLYLQMNSLRAEDTAVYYCAKGRGNTSDFDYWGQGTLVTVSS

SEQ ID NO: 217 - protein, 118 aa, Artificial Sequence
  Description of Artificial Sequence: Synthetic polypeptide
EVQLLESGGGLVQPGGSLRLSCAASGFTFSNYDMAWVRQAPGKGLEWVSTISGAGHFTYYADSVKGRFTISRDNSKNTLYLQMNSLRAEDTAVYYCAKSFPRDEFDYWGQGTLVTVSS

SEQ ID NO: 218 - protein, 118 aa, Artificial Sequence
  Description of Artificial Sequence: Synthetic polypeptide
EVQLLESGGGLVQPGGSLRLSCAASGFTFPKYEMRWVRQAPGKGLEWVSEIGLDGSPTYYADSVKGRFTISRDNSKNTLYLQMNSLRAEDTAVYYCAKLGDPNGFDYWGQGTLVTVSS

SEQ ID NO: 219 - protein, 116 aa, Artificial Sequence
  Description of Artificial Sequence: Synthetic polypeptide
EVQLLESGGGLVQPGGSLRLSCAASGFTFPTSEMDWVRQAPGKGLEWVSGIGPDGLTTYYADSVKGRFTISRDNSKNTLYLQMNSLRAEDTAVYYCAKHADWFDYWGQGTLVTVSS

SEQ ID NO: 220 - protein, 116 aa, Artificial Sequence
  Description of Artificial Sequence: Synthetic polypeptide
EVQLLESGGGLVQPGGSLRLSCAASGFTFSEYDMYWVRQAPGKGLEWVSWIDTDGGDTYYADSVKGRFTISRDNSKNTLYLQMNSLRAEDTAVYYCAKPGLKFDYWGQGTLVTVSS

SEQ ID NO: 221 - protein, 117 aa, Artificial Sequence
  Description of Artificial Sequence: Synthetic polypeptide
EVQLLESGGGLVQPGGSLRLSCTASGFTFENASMQWVRQAPGKGLEWVSSIEGQGNATYYADSVKGRFTISRDNSKNTLYLQMNSLRAEDTAVYYCAKSSSWSFDYWGQGTLVTVSS

SEQ ID NO: 222 - protein, 119 aa, Artificial Sequence
  Description of Artificial Sequence: Synthetic polypeptide
EVQLLESGGGLVQPGGSLRLSCAASGFTFTRNEMGWVRQAPGKGLEWVSTITPTGTFTYYADSVKGRFTISRDNSKNTLYLQMNSLRAEDTAVYYCAKTDPGNRYFDYWGQGTLVTVSS

SEQ ID NO: 223 - protein, 118 aa, Artificial Sequence
  Description of Artificial Sequence: Synthetic polypeptide
EVQLLESGGGLVQPGGSLRLSCAASGFTFNWQLMGWVRQAPGKGLEWVSGIEGPGDVTYYADSVKGRFTISRDNSKNTLYLQMNSLRAEDTAVYYCAKVGKESNFDYRGQGTLVTVSS

SEQ ID NO: 224 - protein, 118 aa, Artificial Sequence
  Description of Artificial Sequence: Synthetic polypeptide
EVQLLESGGGLVQPGGSLRLSCAASGFTFNWQLMGWFRQAPGKGLEWVSGIEGPGDVTYYADSVKGRFTISRDNSKNTLYLQMNSLRAEDTAVYYCAKVGKESNFDYRGQGTLVTVSS

SEQ ID NO: 225 - protein, 118 aa, Artificial Sequence
  Description of Artificial Sequence: Synthetic polypeptide
EVQLLESGGGLVQPGGSLRLSCAASGFTFNWQLMGWVRQAPGKGLEWVSGIEGPGDVTYYADSVKGRFTVSRDNSKNTLYLQMNSLRAEDTAVYYCAKVGKESNSDYRGQGTLVTVSS

SEQ ID NO: 226 - protein, 118 aa, Artificial Sequence
  Description of Artificial Sequence: Synthetic polypeptide
EVQLLESGGGLVQPGGSLRLSCAASGFTFNWQLMGWVRQAPGKGLEWVSGIEGPGDVTYYADSVKGRFTISRDNSKNTLYLQMNSLRAEDTAVYYCVKVGKESNSDYRGQGTQVTVSS

SEQ ID NO: 227 - protein, 118 aa, Artificial Sequence
  Description of Artificial Sequence: Synthetic polypeptide
EVQLLESGGGLVQPGGSLRLSCAASGFTFNWQLMGWARQAPGKGLEWVSGIEGPGDVTYYADSVKGRFTISRDNSKNTLYLQMNSLRAEDTAVYYCAKVGKESNSDYRGQGTLVTVSS

SEQ ID NO: 228 - protein, 118 aa, Artificial Sequence
  Description of Artificial Sequence: Synthetic polypeptide
EVQLLESGGGLVQPGGSLRLSCAASGFTFNWQLMGWARQAPGKGLEWVSGIEGPGDVTYYADSVKDRFTISRDNSKNTLYLLMNSLRAEDTAVYYCAKVGKESNFDYWGQGTLVTVSS

SEQ ID NO: 229 - protein, 118 aa, Artificial Sequence
  Description of Artificial Sequence: Synthetic polypeptide
EVQLLESGGGLVQPGGSLRLSCAASGFTFNWQLMGWVRQAPGKGLEWVSGIEGPGDVTYYADSVKGRFTISRDNTKNTLYLQMNSLRAEDTAVYYCVKVGKESNSDYRGQGTLVTVSS

SEQ ID NO: 230 - protein, 118 aa, Artificial Sequence
  Description of Artificial Sequence: Synthetic polypeptide
EVRLLESGGGLVQPGGSLRLSCAASGFNFNWQLMGWIRQAPGKGLEWVSGIEGPGDVTYYADSVKGRFTISRDNSKNTLYLQMNSLRAEDTAVYYCAKVGKESNSDYRGQGTLVTVSS

SEQ ID NO: 231 - protein, 118 aa, Artificial Sequence
  Description of Artificial Sequence: Synthetic polypeptide
EVQLLESGGGLVRPGGSLRLSCVASGFTFNWQLMGWVRQAPGKGLEWVSGIEGPGDVTYYADSVKGRFTISRDNSKNTLYLQMNSLRAEDTAVYYCAKVGKESNFDYRGQGTLVTVSS

SEQ ID NO: 232 - protein, 118 aa, Artificial Sequence
  Description of Artificial Sequence: Synthetic polypeptide
EVQLLESGGGLVQTGGSLRLSCAASGFTYNWQLMGWVRQAPGKGLEWVSGIEGPGDVTYYADSVKGRFTISRDNSKNTLYLQMNSLRADDTAVYYCVKVGKESNFDYRGHGTLVTVSS

SEQ ID NO: 233 - protein, 118 aa, Artificial Sequence
  Description of Artificial Sequence: Synthetic polypeptide
EVQLLESGGGLVQPGGSLRLSCAASGFTFNWQLMGWVRKAPGKGLEWVSGIEGPGDVTYYADSVKGRFTISRDNSKNTLYLQMNSLRAEDTAVYYCAKVGKESNFDYRGQGTLVTVSS

SEQ ID NO: 234 - protein, 118 aa, Artificial Sequence
  Description of Artificial Sequence: Synthetic polypeptide
EVQLLESGGGLVQPGGSLRLSCAASGFTFNWQLMGWVRQAPGKGLEWVSGIEGPGDVTYYADSVKGRFTISRDNTKNTLYLQMNSLRAEDTAVYYCAKVGKESNFDYRGQGTLVTVSS

SEQ ID NO: 235 - protein, 118 aa, Artificial Sequence
  Description of Artificial Sequence: Synthetic polypeptide
EVQLLESGGGLVQPGGSLRLSCAASGFTFNWQLMGWVRQAPGKGLEWVSGIEGPGDVTYYADSVKGRFTISRDNSKNTLYLQMNSLRAEDTAVYYCAKVGKESKFDYLGQGTLVTVSS

SEQ ID NO: 236 - protein, 118 aa, Artificial Sequence
  Description of Artificial Sequence: Synthetic polypeptide
EVQLLESGGGLVQPGGSLRLSCAASGFTFNWQLMGWVRQAPGKGLEWVSGIEGPGDVTYYAESVKGRFTISRDNSKNTLYLQMNSLRAEDTAVYYCAKVGKESNLDYRGQGTLVTVSS

SEQ ID NO: 237 - protein, 118 aa, Artificial Sequence
  Description of Artificial Sequence: Synthetic polypeptide
EVQLFESGGGSVQPGGSLRLSCAASGFTFNWQLMGWVRQAPGKGLEWVSGIEGPGDVTYYADSVKGRFTISRDNSKNTLYLQMNSLRAEDTAVYYCAKVGKESNSDYRGQGTLVTVSS

SEQ ID NO: 238 - protein, 118 aa, Artificial Sequence
  Description of Artificial Sequence: Synthetic polypeptide
EVQLLESGGGLVQPGGSLRLTCAASGFTFNWQLMGWVRQAPGKGLEWVSGIEGPGDVTYYADSVKGRFIISRDNSKNTLYLQMNSLRAEDTAVYYCAKVGKESNSDYRGQGTLVTVSS

SEQ ID NO: 239 - protein, 118 aa, Artificial Sequence
  Description of Artificial Sequence: Synthetic polypeptide
EVQLLESGGGLVQPGGSLRLSCAASGFTFNWQLMGWVRQAPGKGLEWVSGIEGPGDVTYYADSVKGRFTISRDNSTNTLYLQMNSLRAEDTAVYYCAKVGKESEFDYRGQGTLVTVSS

SEQ ID NO: 240 - protein, 118 aa, Artificial Sequence
  Description of Artificial Sequence: Synthetic polypeptide
EVRLLESGGGLVQPGGSLRLSCAASGFTFNWQLMGWVRQAPGKGLEWVSGIEGPGDVTYYADSVKGRFTITRDNSKNTLYLQMNSLRAEDTAVYYCVKVGKESNLDYRGQGTLVTVSS

SEQ ID NO: 241 - protein, 118 aa, Artificial Sequence
  Description of Artificial Sequence: Synthetic polypeptide
EVQLLVSGGGLVQPGGSLRLSCAASGFTFNWQLMGWVRQAPGKGLEWVSGIEGPGDVTYYADSVKGRFTISRDNSKNTLYLQMNSLRAEDTAVYYCAKVGKESNFDYRGQGTLVTVSS

SEQ ID NO: 242 - protein, 118 aa, Artificial Sequence
  Description of Artificial Sequence: Synthetic polypeptide
EVQLLVSGGGLVQPGGSLRLSCAASGFTFNWQLMGWVRQAPGKGLEWVSGIEGPGDVTYYADSVKGRFTISRDNSKNMLYLQMNGLRAEDTAVYYCAKVGKESNFDYRGQGTLVTVSS

SEQ ID NO: 243 - protein, 118 aa, Artificial Sequence
  Description of Artificial Sequence: Synthetic polypeptide
EVQLLESGGGLVQPGGSLRLSCAASGFTFNWQLMGWVRQAPGKGLEWVSGIEGPGDVTYYADSVKGRFTISRDNSKNTLYLQMNSLRAEDTAVYYCVKVGKESNSDYRGQGTLVTVSS

SEQ ID NO: 244 - protein, 118 aa, Artificial Sequence
  Description of Artificial Sequence: Synthetic polypeptide
EVQLLESGGGLVQPGGSLRLSCAASGFTFKWQLMGWARQAPGKGLEWVSGIEGPGDVTYYADPVKGRFTISRDNSKNTLYLQMNSLRAEDTAVYYCVKVGKESNSDYRGQGTLVTVSS

SEQ ID NO: 245 - protein, 118 aa, Artificial Sequence
  Description of Artificial Sequence: Synthetic polypeptide
EVQLLESGGGLVQPGGSLRLSCAASGFTFKWHLMGWVRQAPGKGLEWVSGIEGPGDVTYYADSVKGRFTISRDNSKNTLYLQMNSLRAEDTAVYYCVKVGKESSSDYRGQGTLVTVSS

SEQ ID NO: 246 - protein, 118 aa, Artificial Sequence
  Description of Artificial Sequence: Synthetic polypeptide
EVQLLESGGGLVQPGGSLRLSCAASGFTFNWHLMAWARQAPGKGLEWVSGIEGPGDVTYYADSVKGRFTISRDNSKNTLYLQMNSLRAEDTAVYYCVKVGKESNSDYRGQGTLVTVSS

SEQ ID NO: 247 - protein, 118 aa, Artificial Sequence
  Description of Artificial Sequence: Synthetic polypeptide
EVQLLESGGGLVQPGGSLRLSCAASGFTFKWQLMGWVRQAPGKGLEWVSGIEGPGDVTYYADSVKGRFTISRDNSKNTLYLQMNSLRAEDTAVYYCVKVGKESNSDYRGQGTLVTVSS

SEQ ID NO: 248 - protein, 118 aa, Artificial Sequence
  Description of Artificial Sequence: Synthetic polypeptide
EVQLLESGGGLVQPGGSLRLSCAASGFTFKWQLMAWARQAPGKGLEWVSGIEGPGDITYYADSVKGRFTISRDNSKNTLYLQMNSLRAEDTAVYYCVKVGKESNSDYRGQGTLVTVSS

SEQ ID NO: 249 - protein, 118 aa, Artificial Sequence
  Description of Artificial Sequence: Synthetic polypeptide
EVQLLESGGGLVQPGGSLRLSCAASGFTFNWHLMGWARQAPGKGLEWVSGIEGPGDVTYYADSVKGRFTISRDNSKNTLYLQMNSLRAEDTAVYYCVKVGKESNSDYRGQGTLVTVSS

SEQ ID NO: 250 - protein, 118 aa, Artificial Sequence
  Description of Artificial Sequence: Synthetic polypeptide
EVQLLESGGGLVQPGGSLRLSCAASGFTFKWQLMGWARQAPGKGLEWVSGIEGPGDVTYYADSVKGRFTISRDNSKNTLYLQMNSLRAEDTAVYYCVKVGKESNSDYRGQGTLVTVSS

SEQ ID NO: 251 - protein, 118 aa, Artificial Sequence
  Description of Artificial Sequence: Synthetic polypeptide
EVQLLESGGGLVQPGGSLRLSCAASGFTFNWELMGWARQAPGKGLEWVSGIEGPGDVTYYADSVKGRFTISRDNSKNTLYLQMNSLRAEDTAVYYCVKVGKESNSDYRGQGTLVTVSS

SEQ ID NO: 252 - protein, 118 aa, Artificial Sequence
  Description of Artificial Sequence: Synthetic polypeptide
EVQLLESGGGLVQPGGSLRLSCAASGFTFNWQLMGWARQAPGKGLEWVSGIEGPGDVTYYADSVKGRFTISRDNSKNTLYLQMNSLRAEDTAVYYCVKVGKESNSDYRGQGTLVTVSS

SEQ ID NO: 253 - protein, 118 aa, Artificial Sequence
  Description of Artificial Sequence: Synthetic polypeptide
EVQLLESGGGLVQPGGSLRLSCAASGFTFNWQLMGWVRQAPGKGLEWVSGIEGPGDVTYYADSVKGRFTISRDNSKNTLYLQMNSLRAEDTAVYYCVKVGKDSKSDYRGQGTLVTVSS

SEQ ID NO: 254 - protein, 118 aa, Artificial Sequence
  Description of Artificial Sequence: Synthetic polypeptide
EVQLLESGGGLVQPGGSLRLSCAASGFTFNWQLMGWVRRAPGKGLEWVSGIEGPGDVTYYADSVKGRFTISRDNSKNTLYLQMNSLRAEDTAVYYCVKVGKDSKSDYRGQGTLVTVSS

SEQ ID NO: 255 - protein, 118 aa, Artificial Sequence
  Description of Artificial Sequence: Synthetic polypeptide
EVQLLESGGGLVQPGGSLRLSCAASGFTFNWQLMGWVRQAPGKGLEWVSGIEGPGDVTYYADSVKGRFTISRDNSKNTLYLQMNSLRAEDTAVYYCVKVGKDSNSDYRGQGTLVTVSS

SEQ ID NO: 256 - protein, 118 aa, Artificial Sequence
  Description of Artificial Sequence: Synthetic polypeptide
EVQLLESGGGLAQPGGSLRLSCAASGFTFNWQLMGWVRQAPGKGLEWVSGIEGPGDVTYYADSVKGRFTISRDNSKNTLYLQMNSLRAEDTAVYYCVKVGKDSKSDYRGQGTLVTVSS

SEQ ID NO: 257 - protein, 118 aa, Artificial Sequence
  Description of Artificial Sequence: Synthetic polypeptide
EVQLLESGGGLVQPGGSLRLSCAASGFTFNWQLMGWVRQAPGKGLEWVSGIEGPGDVTYYADSVKGRFTISRDNSKNTLYLQMNSLRAEDTAVYYCVKVGKDAKSDYRGQGTLVTVSS

SEQ ID NO: 258 - protein, 118 aa, Artificial Sequence
  Description of Artificial Sequence: Synthetic polypeptide
EVQLLESGGGLVQPGGSLRLSCAASGFTFNWQLMGWVRQAPGKGLEWVSGIEGPGDVTYYADSVKGRFTISRDNSKNTLYLQMNSLRAEDTAVYYCVKVGKDKNSDYRGQGTLVTVSS

SEQ ID NO: 259 - protein, 118 aa, Artificial Sequence
  Description of Artificial Sequence: Synthetic polypeptide
EVQLLESGGGLVQPGGSLRLSCAASGFTFNWQLMGWVRQAPGKGLEWVSGIEGPGDVTYYADSVKGRFTISRDNSKNTLYLQMNSLRAEDTAVYYCVKVGKESKSDYRGQGTLVTVSS

SEQ ID NO: 260 - protein, 118 aa, Artificial Sequence
  Description of Artificial Sequence: Synthetic polypeptide
EVQLLESGGGLVQPGGSLRLSCAASGFTFNWQLMGWVRQAPGKGLEWVSGIEGPGDVTYYADSVKGRFTISRDNSKNTLYLQMNSLRAEDTAVYYCVKVGRDSKSDYRGQGTLVTVSS

SEQ ID NO: 261 - protein, 118 aa, Artificial Sequence
  Description of Artificial Sequence: Synthetic polypeptide
EVQLLESGGGLVQPGGSLRLSCAASGFTFNWQLMGWVRQAPGKGLEWVSGIEGPGDVTYYADSVKGRFTISRDNSKNTLYLQMNSLRAEDTAVYYCVKVGKYSNSDYRGQGTLVTVSS

SEQ ID NO: 262 - protein, 118 aa, Artificial Sequence
  Description of Artificial Sequence: Synthetic polypeptide
EVQLLESGGGLVQPGGSLRLSCAASGFTFNWQLMGWVRQAPGKGLEWVSGIEGPGDVTYYADSVKGRFTISRDNSKNTLYLQMNSLRAEDTAVYYCVKVGKDSRSDYRGQGTLVTVSS

SEQ ID NO: 263 - protein, 118 aa, Artificial Sequence
  Description of Artificial Sequence: Synthetic polypeptide
EVQLLESGGGLVQPGGSLRLSCAASGFTFNWQLMGWVRQAPGKGLEWVSGIEGPGDVTYYADSVKGRFTISRDNSKNTLYLQMNSLRAEDTAVYYCVKVGKDDSSDYRGQGTLVTVSS

SEQ ID NO: 264 - protein, 118 aa, Artificial Sequence
  Description of Artificial Sequence: Synthetic polypeptide
EVQLLEFGGGLVQPGGSLRFSCAASGFTFNWQLMGWFRQAPGKGLEWVSGIEGPGDVTYYADSVKGRFTISRDNSKNTLYLQMNSLRAEDTAVYYCVKVGRDSNSDYRGQGTLVTVSS

SEQ ID NO: 265 - protein, 118 aa, Artificial Sequence
  Description of Artificial Sequence: Synthetic polypeptide
EVQLLESGGGLVQPGGSLRLSCAASGFTFNWQLMGWVRQAPGKGLEWVSGIEGPGDVTYYADSVKGRFTISRDNSKNTLYLQMNSLRAEDTAVYYCVKVGKDSTSDYRGQGTLVTVSS

SEQ ID NO: 266 - protein, 118 aa, Artificial Sequence
  Description of Artificial Sequence: Synthetic polypeptide
EVQLLESGGGLVQPGGSLRLSCAASGFTFNWQLMGWVRQAPGKGLEWVSGIEGPGDVTYYADSVKGRFTISRDNSKNTLYLQMNSLRAEDTAVYYCVKVGKESSSDYRGQGTLVTVSS

SEQ ID NO: 267 - protein, 118 aa, Artificial Sequence
  Description of Artificial Sequence: Synthetic polypeptide
EVQLLESGGGLVQPGGSLRLSCAASGFTFNWQLMGWVRQAPGKGLEWVSGIEGPGDVTYYADSVKGRFTIFRDNSKNTLYLQMNSLRAEDTAVYYCVKVGKDSASDYRGQGTLVTVSS

SEQ ID NO: 268 - protein, 118 aa, Artificial Sequence
  Description of Artificial Sequence: Synthetic polypeptide
EVQLLESGGGLVQPGGSLRLSCAASGFTFNWQLMGWVRQAPGKGLEWVSGIEGPGDVTYYADSVKGRFTISRDNSKNTLYLQMNSLRAEDTAVYYCVKVGNDSYSDYRGQGTLVTVSS

SEQ ID NO: 269 - protein, 118 aa, Artificial Sequence
  Description of Artificial Sequence: Synthetic polypeptide
EVQLLESGGGLVQPGGSLRLSCAASGFTFNWQLMGWVRQAPGKGLEWVSGIEGPGDVTYYADSVKGRFTISRDNSKNTLYLQMNGLRAEDTAVYYCVKVGKDSSSDYRGQGTLVTVSS

SEQ ID NO: 270 - protein, 118 aa, Artificial Sequence
  Description of Artificial Sequence: Synthetic polypeptide
EVQLLESGGGLVQPGGSLRLSCAASGFTFNWQLMGWVRQAPGKGLEWVSGIEGPGDVTYYADSVKGRFTISRDNSKNTLYLQMNSLRAEDTAIYYCVKVGKDSASDYRGQGTLVTVSS

SEQ ID NO: 271 - protein, 118 aa, Artificial Sequence
  Description of Artificial Sequence: Synthetic polypeptide
EVQLLESGGGLVQPGGSLRLSCAASGFTFKWQLMGWVRQAPGKGLEWVSGIEGPGDVTYYADSVKGRFTISRDNSKNTLYLQMNSLRAEDTAVYYCVKVGKDAKSDYRGQGTLVTVSS

SEQ ID NO: 272 - protein, 118 aa, Artificial Sequence
  Description of Artificial Sequence: Synthetic polypeptide
EVQLLESGGGLVQPGGSLRLSCAASGFTFKWQLMGWVRQAPGKGLEWVSGIEGPGDVTYYADSVKGRFTISRDNSKNTLYLQMNSLRAEDTAVYYCVKVGKDSRSDYRGQGTLVTVSS

SEQ ID NO: 273 - protein, 118 aa, Artificial Sequence
  Description of Artificial Sequence: Synthetic polypeptide
EVQLLESGGGLVQPGGSLRLSCAASGFTFKWQLMGWVRQAPGKGLEWVSGIEGPGDVTYYADSVKGRFTISRDNSKNTLYLQMNSLRAEDTAVYYCVKVGKDSKSDYRGQGTLVTVSS

SEQ ID NO: 274 - protein, 118 aa, Artificial Sequence
  Description of Artificial Sequence: Synthetic polypeptide
EVQLLESGGGLVQPGGSLRLSCAASGFTFNWELMGWARQAPGKGLEWVSGIEGPGDVTYYADSVKGRFTISRDNSKNTLYLQMNSLRAEDTAVYYCVKVGKDAKSDYRGQGTLVTVSS

SEQ ID NO: 275 - protein, 118 aa, Artificial Sequence
  Description of Artificial Sequence: Synthetic polypeptide
EVQLLESGGGLVQPGGSLRLSCAASGFTFNWELMGWARQAPGKGLEWVSGIEGPGDVTYYADSVKGRFTISRDNSKNTLYLQMNSLRAEDTAVYYCVKVGKDSRSDYRGQGTLVTVSS

SEQ ID NO: 276 - protein, 118 aa, Artificial Sequence
  Description of Artificial Sequence: Synthetic polypeptide
EVQLLESGGGLVQPGGSLRLSCAASGFTFNWELMGWARQAPGKGLEWVSGIEGPGDVTYYADSVKGRFTISRDNSKNTLYLQMNSLRAEDTAVYYCVKVGKDSKSDYRGQGTLVTVSS

SEQ ID NO: 277 - protein, 118 aa, Artificial Sequence
  Description of Artificial Sequence: Synthetic polypeptide
EVQLLESGGGLVQPGGSLRLSCAASGFTFNWQLMGWARQAPGKGLEWVSGIEGPGDVTYYADSVKGRFTISRDNSKNTLYLQMNSLRAEDSAVYYCAKVGKESNFDYLGQGTLVTVSS

SEQ ID NO: 278 - protein, 118 aa, Artificial Sequence
  Description of Artificial Sequence: Synthetic polypeptide
EVQLLESGGGLVQPGGSLRLSCVASGFTFNWQLMGWVRQAPGKGLEWVSGIEGPGDVTYYADSVKGRFTISRDNSKNTLYLQMNSLRAEDTAVYYCAKVGKESNSDYRGQGTLVTVSS

SEQ ID NO: 279 - protein, 118 aa, Artificial Sequence
  Description of Artificial Sequence: Synthetic polypeptide
EVQLLESGGGLVQPGGSLRLSCAASGFTFNWQLMGWVRQAPGKGLEWVSGIEGPGDVTYYADSVKGRFTISRDNSKNTLYLQMNSLRAEDTAVYYCAKVGKESNSDYRGQGTLVTVSS

SEQ ID NO: 280 - protein, 120 aa, Artificial Sequence
  Description of Artificial Sequence: Synthetic polypeptide
EVQLLESGGGLVQPGGSLRLSCAASGFTFSGWEMGWVRQAPGKGLEWVSSIDESGLNTYYADSVKGRFTISRDNSKNTLYLQMNSLRAEDTAVYYCAEGAPQYQITFDYWGQGTLVTVSS

SEQ ID NO: 281 - protein, 120 aa, Artificial Sequence
  Description of Artificial Sequence: Synthetic polypeptide
EVQLLESGGGLVQPGGSLRLSCAASGFTFPNYGMYWVRQAPGKGLEWVSYISRRGLLTYYADSVKGRFTISRDNSKNTLYLQMNSLRAEDTAVYYCAKTSHYMNNGFDYWGQGTLVTVSS

SEQ ID NO: 282 - protein, 123 aa, Artificial Sequence
  Description of Artificial Sequence: Synthetic polypeptide
EVQLLESGGGLVQPGGSLRLSCAASGFTFVDYTMAWVRQAPGKGLEWVSSISPIGTFTYYADSVKGRFTISRDNSKNTLYLQMNSLRAEDTAVYYCAKDPYGMEDGLTWFDYWGQGTLVTVSS

SEQ ID NO: 283 - protein, 116 aa, Artificial Sequence
  Description of Artificial Sequence: Synthetic polypeptide
EVQLLESGGGLVQPGGSLRLSCAASGFTFDAYDMQWVRQAPGKGLEWVSTITSEGLSTYYADSVKGRFTISRDNSKNTLYLQMNSLRAEDTAVYYCAKPSDLFDYWGQGTLVTVSS

SEQ ID NO: 284 - protein, 121 aa, Artificial Sequence
  Description of Artificial Sequence: Synthetic polypeptide
EVQLLESGGGLVQPGGSLRLSCAASGFTFDGYDMGWVRQAPGKGLEWVSTISRGGWFTYYADSVKGRFTISRDNSKNTLYLQMNSLRAEDTAVYYCAKGTSQSSTGSFDYWGQGTLVTVSS

SEQ ID NO: 285 - protein, 116 aa, Artificial Sequence
  Description of Artificial Sequence: Synthetic polypeptide
EVQLLESGGGLVQPGGSLRLSCAASGFTFRRYDMLWARQAPGKGLEWVSEISPTGALTYYADSVKGRFTISRDNSKNTLYLQMNSLRAEDTAVYYCAKLGSTFDYWGQGTLVTVSS

SEQ ID NO: 286 - protein, 119 aa, Artificial Sequence
  Description of Artificial Sequence: Synthetic polypeptide
EVQLLESGGGLVQPGGSLRLSCAASGFTFFPYYMSWVRQAPGKGLEWVSSISGTGGLTYYADSVKGRFTISRDNSKNTLYLQMNSLRAEDTAVYYCAKTTQNATLFDYWGQGTLVTVSS

SEQ ID NO: 287 - protein, 116 aa, Artificial Sequence
  Description of Artificial Sequence: Synthetic polypeptide
EVQLLESGGGLVQPGGSLRLSCAASGFTFEVYTMAWVRQAPGKGLEWVSTIDESGRDTYYADSVKGRFTISRDNSKNTLYLQMNSLRAEDTAVYYCAKPGVWFDYWGQGTLVTVSS

SEQ ID NO: 288 - protein, 124 aa, Artificial Sequence
  Description of Artificial Sequence: Synthetic polypeptide
EVQLLESGGGLVQPGGSLRLSCAASGFTFAFYKMGWVRQAPGKGLEWVSTITPKGHHTYYADSVKGRFTISRDNSKNTLYLQMNSLRAEDTAVYYCAKVFKGKGWTRPSGFDYWGQGTLVTVSS

SEQ ID NO: 289 - protein, 120 aa, Artificial Sequence
  Description of Artificial Sequence: Synthetic polypeptide
EVQLLESGGGLVQPGGSLRLSCAASGFTFNEYSMMWVRQAPGKGLEWVSSIGRRGWLTYYADSVKGRFTISRDNSKNTLYLQMNSLRAEDTAVYYCAKAVLLDSTKFDYWGQGTLVTVSS

SEQ ID NO: 290 - protein, 121 aa, Artificial Sequence
  Description of Artificial Sequence: Synthetic polypeptide
EVQLLESGGGLVQPGGSLRLSCAASGFTFDEYPMTWVRQAPGKGLEWVSTISARGPFTYYADSVKGRFTISRDNSKNTLYLQMNSLRAEDTAVYYCAKGRHWLRNGRFDYWGQGTLVTVSS

SEQ ID NO: 291 - protein, 116 aa, Artificial Sequence
  Description of Artificial Sequence: Synthetic polypeptide
EVQLLESGGGLVQPGGSLRLSCAASGFTFGMQSMQWVRQAPGKGLEWVSSITDDGTSTYYADSVKGRFTISRDNSKNTLYLQMNSLRAEDTAVYYCAKPDRVFDYWGQGTLVTVSS

SEQ ID NO: 292 - protein, 116 aa, Artificial Sequence
  Description of Artificial Sequence: Synthetic polypeptide
EVQLLESGGGLVQPGGSLRLSCAASGFTFGAADMQWVRQAPGKGLEWVSLITNDGISTYYADSVKGRFTISRDNSKNTLYLQMNSLRAEDTAVYYCAKAGDRFDYWGQGTLVTVSS

SEQ ID NO: 293 - protein, 121 aa, Artificial Sequence
  Description of Artificial Sequence: Synthetic polypeptide
EVQLLESGGGLVQPGGSLRLSCAASGFTFNKYRMQWVRQAPGKGLEWVSSIDSSGELTYYADSVKGRFTISRDNSKNTLYLQMNSLRAEDTAVYYCAEEVPMGNQTFFDYWGQGTLVTVSS

SEQ ID NO: 294 - protein, 119 aa, Artificial Sequence
  Description of Artificial Sequence: Synthetic polypeptide
EVQLLESGGGLVQPGGSLRLSCAASGFTFTDYTMGWVRQAPGKGLEWVSSITSQGAFTYYADSVKGRFTISRDNSKNTLYLQMNSLRAEDTAVYYCAKATGTDSSFDYWGQGTLVTVSS

SEQ ID NO: 295 - protein, 116 aa, Artificial Sequence
  Description of Artificial Sequence: Synthetic polypeptide
EVQLLESGGGLVQPGGSLRLSCAASGFTFEDYEMSWVRQAPGKGLEWVSCIGPGGKPTYYADSVKGRFTISRDNSKNTLYLQMNSLRAEDTAVYYCAKVDGHFDYWGQGTLVTVSS

SEQ ID NO: 296 - protein, 119 aa, Artificial Sequence
  Description of Artificial Sequence: Synthetic polypeptide
EVQLLESGGGLVQPGGSLRLSCAASGFTFSQYDMGWVRQAPGKGLEWVSTISSRGWLTYYADSVKGRFTISRDNSKNTLYLQMNSLRAEDTAVYYCAKGPGGRRRFDYWGQGTLVTVSS

SEQ ID NO: 297 - protein, 124 aa, Artificial Sequence
  Description of Artificial Sequence: Synthetic polypeptide
EVQLLESGGGLVQPGGSLRLSCAASGFTFLDYAMGWVRQAPGKGLEWVSTISPMGMGTYYADSVKGRFTISRDNSKNTLYLQMNSLRAEDTAVYYCAKSSAISFTSDISNFDYWGQGTLVTVSS

SEQ ID NO: 298 - protein, 123 aa, Artificial Sequence
  Description of Artificial Sequence: Synthetic polypeptide
EVQLLESGGGLVQPGGSLRLSCAASGFTFSDYPMSWVRQAPGKGLEWVSSISWSGFQTYYADSVKGRFTISRDNSKNTLYLQMNSLRAEDTAVYYCAKPGVARMPTGIAFDYWGQGTLVTVSS

SEQ ID NO: 299 - protein, 116 aa, Artificial Sequence
  Description of Artificial Sequence: Synthetic polypeptide
EVQLLESGGGLVQPGGSLRLSCAASGFTFSAYEMQWVRQAPGKGLEWVSSIDSAGTFTYYADSVKGRFTISRDNSKNTLYLQMNSLRAEDTAVYYCAEPFGMFDYWGQGTLVTVSS

SEQ ID NO: 300 - protein, 124 aa, Artificial Sequence
  Description of Artificial Sequence: Synthetic polypeptide
EVQLLESGGGLVQPGGSLRLSCAASGFTFSEYPMKWVRQAPGKGLEWVSTIDRQGDRTYYADSVKGRFTISRDNSKNTLYLQMNSLRAEDTAVYYCAKTVRRGLPRPSRYFDYWGQGTLVTVSS

SEQ ID NO: 301 - protein, 121 aa, Artificial Sequence
  Description of Artificial Sequence: Synthetic polypeptide
EVQLLESGGGLVQPGGSLRLSCAASGFTFSDYDMGWVRQAPGKGLEWVSSISPMGTFTYYADSVKGRFTISRDNSKNTLYLQMNSLRAEDTAVYYCAKGLSVYSGLDFDYWGQGTLVTVSS

SEQ ID NO: 302 - protein, 123 aa, Artificial Sequence
  Description of Artificial Sequence: Synthetic polypeptide
EVQLLESGGGLVQPGGSLRLSCAASGFTFSHYDMGWVRQAPGKGLEWVSDIDYIGKTTYYADSVKGRFTISRDNSKNTLYLQMNSLRAEDTAVYYCAKASDEVGVNTSKFDYWGQGTLVTVSS

SEQ ID NO: 303 - protein, 116 aa, Artificial Sequence
  Description of Artificial Sequence: Synthetic polypeptide
EVQLLESGGGLVQPGGSLRLSCAASGFTFARYDMGWVRQAPGKGLEWVSTISPTGVLTYYADSVKGRFTISRDNSKNTLYLQMNSLRAEDTAVYYCAKGFEDFDYWGQGTLVTVSS

SEQ ID NO: 304 - protein, 116 aa, Artificial Sequence
  Description of Artificial Sequence: Synthetic polypeptide
EVQLLESGGGLVQPGGSLRLSCAASGFTFEAYPMSWVRQAPGKGLEWVSLISHTGHATYYADSVKGRFTISRDNSKNTLYLQMNSLRAEDTAVYYCAKGHWPFDYRGQGTLITVSS

SEQ ID NO: 305 - protein, 119 aa, Artificial Sequence
  Description of Artificial Sequence: Synthetic polypeptide
EVQLLESGGGLVQPGGSLRLSCAASGFTFEDEWMSWVRQAPGKGLEWVSDISPGGWTTYYADSVKGRFTISRDNSKNTLYLQMNSLRAEDTAVYYCAKGYRPFDEFDYWGQGTLVTVSS

SEQ ID NO: 306 - protein, 118 aa, Artificial Sequence
  Description of Artificial Sequence: Synthetic polypeptide
EVQLLESGGGLVQPGGSLRLSCAASGVTFDAIEMSWVRQAPGKGLEWVSSISRHGEYTYYADSVKGRFTISRDNSKNTLYLQMNSLRAEDTAVYYCAEDAWSRHFDYWGQGTLVTVSS

SEQ ID NO: 307 - protein, 116 aa, Artificial Sequence
  Description of Artificial Sequence: Synthetic polypeptide
EVQLLESGGGLVQPGGSLRLSCAASGFTFDSTDMSWVRQAPGKGLEWVSGILDNGSNTYYADSVKGRFTISRDNSKNMLYLQMNSLRAEDTAVYYCAKGARDFDYWGQGTLVTVSS

SEQ ID NO: 308 - protein, 117 aa, Artificial Sequence
  Description of Artificial Sequence: Synthetic polypeptide
EVQLLESGGGLVQPGGSLRLSCAASGFTFGRQSMQWVRQAPGKGLEWVSSIDDDGFSTYYADSVKGRFTISRDNSKNTLYLQMNSLRAEDTAVYYCAKGDPWGFDYWGQGTLVTVSS

SEQ ID NO: 309 - protein, 116 aa, Artificial Sequence
  Description of Artificial Sequence: Synthetic polypeptide
EVQLLESGGGLVQPGGSLRLSCTASGFTFSDTQMAWVRQAPGKGLEWVSGIDDGGVSTYYADSVKGRFTISRDNSKNTLYLQMNSLRAEDTAVYYCAKPDRHFDYWGQGTLVTVSS

SEQ ID NO: 310 - protein, 118 aa, Artificial Sequence
  Description of Artificial Sequence: Synthetic polypeptide
EVQLLESGGGLVQPGGSLRLSCAASGFTFGSTTMGWVRQAPGKGLEWVSVISDDGGFTYYADSVKGRFTISRDNSRNTLYLQMNSLRAEDTAVYYCAKVDGYGVFDYWGQGTLVTVSS

SEQ ID NO: 311 - protein, 116 aa, Artificial Sequence
  Description of Artificial Sequence: Synthetic polypeptide
EVQLLESGGGLVQPGGSLRLSCAASGFTFRSGDMNWVRQAPGKGLEWVSTITNDGTSTYYADSVKGRFTISRDNSKNTLYLQMNSLRAEDTAVYYCAKSDSDFDYWGQGTLVTVSS

SEQ ID NO: 312 - protein, 120 aa, Artificial Sequence
  Description of Artificial Sequence: Synthetic polypeptide
EVQLLESGGGLVQPGGSLRLSCAASGFTFAAYAMTWVRQAPGKGLEWVSYISPNGTATYYADSVKGRFTISRDNSKNTLYLQMNSLRAEDTAVYYCAEYVGMRWNSFDYWGQGTLVTVSS

SEQ ID NO: 313 - protein, 116 aa, Artificial Sequence
  Description of Artificial Sequence: Synthetic polypeptide
EVQLLESGGGLVQPGGSLRLSCAASGFTFSSYEMAWVRQAPGKGLEWVSSITSLGTSTYYADSVKGRFTISRDNSKNTLYLQMNSLRAEDTAVYYCAKPGRKFDYWGQGTLVTVSS

SEQ ID NO: 314 - protein, 116 aa, Artificial Sequence
  Description of Artificial Sequence: Synthetic polypeptide
EVQLLESGGGLVQPGGSLRLSCAASGFTFNEYEMTWVRQAPGKGLEWVSTITSEGSGTYYADSVKGRFTISRDNSKNTLYLQMNSLRAEDTAVYYCAKPNGKFDYWGQGTLVTVSS

SEQ ID NO: 315 - protein, 116 aa, Artificial Sequence
  Description of Artificial Sequence: Synthetic polypeptide
EVQLLESGGGLVQPGGSLRLSCAASGFTFSDYEMLWVRQAPGKGLEWVSTITSEGHSTYYADSVKGRFTISRDNSKNTLYLQMNSLRAEDTAVYYCAKPGTSFDYWGQGTLVTVSS

SEQ ID NO: 316 - protein, 116 aa, Artificial Sequence
  Description of Artificial Sequence: Synthetic polypeptide
EVQLLESGGGLVQPGGSLRLSCAASGFTFSDYEMSWVRQAPGKGLEWVSTIDSDGSFTYYADSVKGRFTISRDNSKNTLYLQMNSLRAEDTAVYYCAKPGVKFDYWGQGTLVTVSS

SEQ ID NO: 317 - protein, 116 aa, Artificial Sequence
  Description of Artificial Sequence: Synthetic polypeptide
EVQLLESGGGLVQPGGSLRLSCAASGFTFKDYEMTWVRQAPGKGLEWVSSISSTGQSTYYADSVKGRFTISRDNSKNTLYLQMNSLRAEDTAVYYCAKPGNKFDYWGQGTLVTVSS

SEQ ID NO: 318 - protein, 124 aa, Artificial Sequence
  Description of Artificial Sequence: Synthetic polypeptide
EVQLLESGGGLVQPGGSLRLSCAASGFTFLDYGMAWVRQAPGKGLEWVSAISPLGLSTYYADSVKSRFTISRDNSKNTLYLQMNSLRAEDTAVYYCAKEVRVGRGVHPPKFDYWGQGTLVTVSS

SEQ ID NO: 319 - protein, 116 aa, Artificial Sequence
  Description of Artificial Sequence: Synthetic polypeptide
EVQLLESGGGLVQPGGSLRLSCAASGFTFNLYEMTWVRQAPGKGLEWVSSITSDGVSTYYADSVKGRFTISRDNSKNTLYLQMNSLRAEDTAVYYCAKAGVIFDYWGQGTLVTVSS

SEQ ID NO: 320 - protein, 123 aa, Artificial Sequence
  Description of Artificial Sequence: Synthetic polypeptide
EVQLLESGGGLVQPGGSLRLSCAASGFTFENYAMSWVRQAPGKGLEWVSTIAPLGVPTYYADSVKGRFTISRDNSKNTLYLQMNSLRAEDTAVYYCAKKKVGAWLQSRSFDYWGQGTLVTVSS

SEQ ID NO: 321 - protein, 120 aa, Artificial Sequence
  Description of Artificial Sequence: Synthetic polypeptide
EVQLLESGGGLVQPGGSLRLSCAASGFTFMDYEMHWVRQAPGKGLEWVSTIGASGHYTYYADSVKGRFTISRDNSKNTLYLQMNSLRAEDTAVYYCAKYLDMLLFGFDYWGQGTLVTVSS

SEQ ID NO: 322 - protein, 116 aa, Artificial Sequence
  Description of Artificial Sequence: Synthetic polypeptide
EVQLLESGGGLVQPGGSLRLSCAASGFTFAEYEMMWARQAPGKGLEWVSRIAGNGSRTYYADSVKGRFTISRDNSKNTLYLQMNSLRAEDTAVYYCAIMLSHFDYWGQGTLVTVSS

SEQ ID NO: 323 - protein, 121 aa, Artificial Sequence
  Description of Artificial Sequence: Synthetic polypeptide
EVQLLESGGGLVQPGGSLRLSCAASGFTFYNYDMSWVRQAPGKGLEWVSGIDSMGLVTYYADSVKGRFTISRDNSKNTLYLQMNSLRAEDTAVYYCAKGSNASDWVVFDYWGQGTLVTVSS

SEQ ID NO: 324 - protein, 121 aa, Artificial Sequence
  Description of Artificial Sequence: Synthetic polypeptide
EVQLLESGGGLVQPGGSLRLSCAASGFTFASYHMTWVRQAPGKGLEWVSSIADTGDRTYYADSVKGRFTISRDNSKNTLYLQMNSLRAEDTAVYYCAKLRGMARVWGFDYWGQGTLVTVSS

SEQ ID NO: 325 - protein, 123 aa, Artificial Sequence
  Description of Artificial Sequence: Synthetic polypeptide
EVQLLESGGGLVQPGGSLRLSCAASGFTFSYYDMMWVRQAPGKGLEWISSISDRGLQTYYADSVKGRFTISRDNSKNTLYLQMNSLRAEDTAVYYCAKFTEIPLDWLEVFDYWGQGTLVTVSS

SEQ ID NO: 326 - protein, 122 aa, Artificial Sequence
  Description of Artificial Sequence: Synthetic polypeptide
EVQLLESGGGLVQPGGSLRLSCAASGFTFGSYKMLWVRQAPGKGLEWVSSITNSGTETYYADSVKGRFTISRDNSKNTLYLQMNSLRAEDTAVYYCAKSMYPDLEIVHFDYWGQGTLVTVSS

SEQ ID NO: 327 - protein, 121 aa, Artificial Sequence
  Description of Artificial Sequence: Synthetic polypeptide
EVQLLESGGGLVQPGGSLRLSCAASGFTFETYRMSWVRQAPGKGLEWVSAIDQEGSATYYADSVKGRFTISRDNSKNTLYLQMNSLRAEDTAVYYCAKNSGTRPGLRFDYWGQGTLVTVSS

SEQ ID NO: 328 - protein, 121 aa, Artificial Sequence
  Description of Artificial Sequence: Synthetic polypeptide
EVQLLESGGGLVQPGGSLRLSCAASGFTFSSYDMLWVRQAPGKGLEWVSRIDASGYFTYYADSVKGRFTISRDNSKNTLYLQMNSLRAEDTAVYYCAQLLKLSLNPNFDYWGQGTLVTVSS

SEQ ID NO: 329 - protein, 120 aa, Artificial Sequence
  Description of Artificial Sequence: Synthetic polypeptide
EVQLLESGGGLVQPGGSLRLSCAASGFTFSSYAMSWVRQAPGKGLEWVSSIHNTGLSTYYADSVKGRFTISRDNSKNTLYLQMNSLRAEDTAVYYCAKGTQHRFVVFDYWGQGTLVTVSS

SEQ ID NO: 330 - protein, 123 aa, Artificial Sequence
  Description of Artificial Sequence: Synthetic polypeptide
EVQLLESGGGLVQPGGSLRLSCAASGFTFEGYPMSWVRQAPGKGLEWVSTISPLGPDTYYADSVKGRFTISRDNSKNTLYLQMNSLRAEDTAVYYCAKLLMGEYLNSRTFDYWGQGTLVTVSS

SEQ ID NO: 331 - protein, 116 aa, Artificial Sequence
  Description of Artificial Sequence: Synthetic polypeptide
EVQLLESGGGLVQPGGSLRLSCAASGFTFNTYSMSWVRQAPGKGLEWVSWIDADGWVTYYADSVKGRFTISRDNSKNTLYLQMNSLRAEDTAVYYCAQTGHTFDYWGQGTLVTVSS

SEQ ID NO: 332 - protein, 116 aa, Artificial Sequence
  Description of Artificial Sequence: Synthetic polypeptide
EVQLLESGGGLVQPGGSLRLSCAASGFTFTDGEMGWARQAPGKGLEWVSRIVDPGDSTYYADSVKGRFTISRDNSKNTLYLQMNSLRAEDTAVYYCAKAGDQFDYWGQGTLVTVSS

SEQ ID NO: 333 - protein, 116 aa, Artificial Sequence
  Description of Artificial Sequence: Synthetic polypeptide
EVQLLESGGGLVQPGGSLRLSCAASGFTFPEYEMKWVRQAPGKGLEWVSTITPSGGHTYYADSVKGRFTISRDNSKNTLYLQMNSLRAEDAAVYYCAIPLSSFDYWGRGTLVTVSS

SEQ ID NO: 334 - protein, 123 aa, Artificial Sequence
  Description of Artificial Sequence: Synthetic polypeptide
EVQLLESGGGLVQPGGSLRLSCAASGFTFSNYVMIWVRQAPGKGLEWVSLINGAGDMTYYADSVKGRFTISRDNSKNTLYLQMNSLRAEDTAVYYCAEGGARSFGVPPNFDYWGQGTLVTVSS

SEQ ID NO: 335 - protein, 116 aa, Artificial Sequence; identical to SEQ ID NO: 332
  Description of Artificial Sequence: Synthetic polypeptide

SEQ ID NO: 336 - protein, 116 aa, Artificial Sequence
  Description of Artificial Sequence: Synthetic polypeptide
EVQLLESGGGLVQPGGSLRLSCVASGFTFTLYNMSWVRQAPGKGLEWVSVISSKGDSTYYADSVKGRFTISRDNSKNTLYLQMNSLRAEDTAVYYCAQTSSVFDYWGQGTLVTVSS

SEQ ID NO: 337 - protein, 123 aa, Artificial Sequence
  Description of Artificial Sequence: Synthetic polypeptide
EVQLLESGGGLVQPGGSLRLSCAASGFTFEAYYMSWVRQAPGKGLEWVSGIVNNGLLTYYADSVKGRFTISRDNSKNMLYLQMNSLRAEDTAVYYCAKSAVHPSYRAELFDYWGQGTLVTVSS

SEQ ID NO: 338 - protein, 119 aa, Artificial Sequence
  Description of Artificial Sequence: Synthetic polypeptide
EVQLLESGGGLVQPGGSLRLSCAASGFTFSSYEMAWVRQAPGKGLEWVSRIEPDGSNTYYADSVKGRFTISRDNSKNTLYLQMNSLRAEDTAVYYCAKGPDNFTMFDYWGQGTLVTVSS

SEQ ID NO: 339 - protein, 116 aa, Artificial Sequence
  Description of Artificial Sequence: Synthetic polypeptide
EVQLLESGGGLVQPGGSLRLSCAASGFTFNKYMMGWVRQAPGKGLEWVSSIDSLGHYTYYADSVKGRFTISRDNSKNTLYLQMNSLRAEDTAVYYCAEAEFPFDYWGQGTLVTVSS

SEQ ID NO: 340 - protein, 116 aa, Artificial Sequence
  Description of Artificial Sequence: Synthetic polypeptide
EVQLLESGGGLVQPGGSLRLSCAASGFTFKRYEMTWVRQAPGKGLEWVSSISSDGSFTYYADSVKGRFTISRDNSKNTLYLQMNSLRAEDTAVYYCAEPFTEFDYWGQGTLVTVSS

SEQ ID NO: 341 - protein, 116 aa, Artificial Sequence
  Description of Artificial Sequence: Synthetic polypeptide
EVQLLESGGGMVQPGGSLRLSCAASGFTFKRYEMMWVRQAPGKGLEWVSSISSDGSFTYYADSVKGRFTISRDNSKNTLYLQMNSLRAEDTAVYYCAEPFTEFDYWGQGTQVTVSS

SEQ ID NO: 342 - protein, 116 aa, Artificial Sequence
  Description of Artificial Sequence: Synthetic polypeptide
EVQLLESGGGMVQPGGSLRLSCAASGFTFKRYEMMWVRQAPGKGLEWVSSISSDGSFTYYADSVKGRFTISRDNSKNTLYLQMNSLRAEDTAVYYCAEPFTEFDYWGQGTLVTVSS

SEQ ID NO: 343 - protein, 116 aa, Artificial Sequence
  Description of Artificial Sequence: Synthetic polypeptide
EVQLLESGGGLVQPGGSLRLSCAASGFTFKRYEMMWVRKAPGKGLEWVSSISSDGSFTYYADSVKGRFTISRDNSENTLYLQMNSLRAEDTAVYYCADPFTEFDYWGQGTLVTVSS

SEQ ID NO: 344 - protein, 116 aa, Artificial Sequence
  Description of Artificial Sequence: Synthetic polypeptide
EVQLLESGGGLVQPGGSLRLSCAASGFTFKRYEMMWVRQAPGKGLEWVSSISSDGSFTYYADSVKGRFTVSRDNSKNTLYLQMNSLRAEDTAVYYCADPFTEFDYWGQGTLVTVSS

SEQ ID NO: 345 - protein, 116 aa, Artificial Sequence
  Description of Artificial Sequence: Synthetic polypeptide
EVQLLESGGGLVQPGGSLRLSCAASGFTFKRYEMMWVRQAPGKGLEWVSSISSDGSFTYYADSVKGRFTISRDNTKNTLYLQMNSLRAEDTAVYYCADPFTELDYWGHGTLVTVSS

SEQ ID NO: 346 - protein, 116 aa, Artificial Sequence
  Description of Artificial Sequence: Synthetic polypeptide
EVQLLESGGGLVRPGGSLRLSCAASGFTFKRYEMMWVRQAPGKGLEWVSSISSDGSFTYYADSVKGRFTISRDNSKNTLYLQMNSLRAEDTAVYFCADPFTEFDYWGQGTLVTVSS

SEQ ID NO: 347 - protein, 116 aa, Artificial Sequence
  Description of Artificial Sequence: Synthetic polypeptide
EVQLLESGGGLVQPGGSLRLSCAASGFAFKRYEMTWVRQAPGKGLEWVSSISSDGSFTYYADSVKGRFTISRDNSKNTLYLHMNSLRAEDTAVYYCADPFTEIDYWGQGTLVTVSS

SEQ ID NO: 348 - protein, 116 aa, Artificial Sequence
  Description of Artificial Sequence: Synthetic polypeptide
EVQLLESGGGLVQPGGSLRLSCAASGFPFKRYEMTWVRQAPGKGLEWVSSISSDGSFTYYADSVKGRFTISRDNSKNTLYLQMNSLRAEDTAVYYCAEPFTEFDYRAQGTLVTVSS

SEQ ID NO: 349 - protein, 116 aa, Artificial Sequence
  Description of Artificial Sequence: Synthetic polypeptide
EVQLLESGGGLVQPGGSLRLSCAASGFTFKRYEMSWVRQAPGKGLEWVSSISSDGSFTYYADSVKGRFTISRDNSKNTLYLQMNSLRAEDTAVYYCADPFTEIDYWGQGTQVTVSS

SEQ ID NO: 350 - protein, 116 aa, Artificial Sequence
  Description of Artificial Sequence: Synthetic polypeptide
EVQLLESGGGLVHPGGSLRLSCAASGFTFKRYEMMWVRQAPGKGLEWVSSISSDGSFTYYADSVKGRFTISRDNSKNTLYLQMNSLRDEDTAVYYCAEPFTEFDYGGQGTLVTVSS

SEQ ID NO: 351 - protein, 116 aa, Artificial Sequence
  Description of Artificial Sequence: Synthetic polypeptide
EVQLLESGGGWVQPGGSLRLSCAASGFTFKRYEMMWVRQAPGKGLEWVSSISSDGSFTYYADSVKGRFTISRDNSKNTLYLQMNSLRAEDTAVYYCADPFTEFDYWGQGTLVTVSS

SEQ ID NO: 352 - protein, 116 aa, Artificial Sequence
  Description of Artificial Sequence: Synthetic polypeptide
EVQLLESGGGLVQPGGSLRLSCAASGFTFKRYEMMWVRQAPGKGLEWVSSISSDGSFTYYADSVKGRFTISRDNSKNTLYLQMNSLRAEDTAVYYCAEPFTEFDYWGHGTLVTVSS

SEQ ID NO: 353 - protein, 116 aa, Artificial Sequence
  Description of Artificial Sequence: Synthetic polypeptide
EVQLLESGGGLVQPGGSLRLSCAASGFTFKRYEMTWVRQAPGKGLEWVSSISSDGSFTYYADSVKGRFTISRDNSKNTLYLQMNSLRAEDTAVYYCAEPFTEIDYRGQGTLVTVSS

SEQ ID NO: 354 - protein, 116 aa, Artificial Sequence
  Description of Artificial Sequence: Synthetic polypeptide
EVQLLESGGGLVQPGGSLRLSCAASGFTFKKYEMMWVRQAPGKGLEWVSSISSDGSFTYYADSVKGRFTISRDNSKNTLYLQMNSLRAEDTAVYYCAEPFTEFDYWGHGTLVTVSS

SEQ ID NO: 355 - protein, 116 aa, Artificial Sequence
  Description of Artificial Sequence: Synthetic polypeptide
EVQLLESGGGLVQPGGSLRLSCAASGFTFNSYEMMWVRQAPGKGLEWVSSISSDGSFTYYADSVKGRFTISRDNSKNTLYLQMNSLRAEDTAVYYCAEPFTEFDYWGHGTLVTVSS

SEQ ID NO: 356 - protein, 116 aa, Artificial Sequence
  Description of Artificial Sequence: Synthetic polypeptide
EVQLLESGGGLVQPGGSLRLSCAASGFTFKRYEMMWVRQAPGKGLEWVSSISSDGSFTYYADSVKGRFTISRDNSKNTLYLQMNSLRAEDTAVYYCADPFTEFDYWGQGTLVTVSS

SEQ ID NO: 357 - protein, 116 aa, Artificial Sequence
  Description of Artificial Sequence: Synthetic polypeptide
EVQLLESGGGLVQPGGSLRLSCAASGFTFKRYEMMWVRQAPGKGLEWVSSISSDGSFTYYADSVKGRFTISRDNSKNTLYLQMNSLRAEDTAVYYCADPFTEMDYWGHGTLVTVSS

SEQ ID NO: 358 - protein, 116 aa, Artificial Sequence
  Description of Artificial Sequence: Synthetic polypeptide
EVQLLESGGGLVQPGGSLRLSCAASGFTFKRYEMMWVRQAPGKGLEWVSSISSDGSFTYYADSVKGRFTISRDNSKNTLYLQMNSLRAEDTAVYYCADPFTEFDYWGHGTLVTVSS

SEQ ID NO: 359 - protein, 116 aa, Artificial Sequence
  Description of Artificial Sequence: Synthetic polypeptide
EVQLLESGGGLVQPGGSLRLSCAASGFTFKRYEMMWVRQAPGKGLEWVSSISSDGSFTYYADSVKGRFTISRDNSKNTLYLQMNSLRAEDTAVYYCAEPFTELDYWGHGTLVTVSS

SEQ ID NO: 360 - protein, 116 aa, Artificial Sequence
  Description of Artificial Sequence: Synthetic polypeptide
EVQLLESGGGLVQPGGSLRLSCAASGFTFKRYEMMWVRQAPGKGLEWVSSISSDGSFTYYAESVKGRFTISRDNSKNTLYLQMNSLRAEDTAVYYCAEPFTEFDYWGHGTLVTVSS

SEQ ID NO: 361 - protein, 116 aa, Artificial Sequence
  Description of Artificial Sequence: Synthetic polypeptide
EVQLLESGGGLVQPGGSLRLSCAASGFTFNTYEMQWVRQAPGKGLEWVSSISSDGSFTYYADSVKGRFTISRDNSKNTLYLQMNSLRAEDTAVYYCAEPFTEFDYWGHGTLVTVSS

SEQ ID NO: 362 - protein, 116 aa, Artificial Sequence
  Description of Artificial Sequence: Synthetic polypeptide
EVQLLESGGGLVQPGGSLRLSCAASGFTFNKYEMMWARQAPGKGLEWVSSISSDGSFTYYADSVKGRFTISRDNSRNTLYLQMNSLRAEDTAVYYCAEPFTEFDYWGHGTLVTVSS

SEQ ID NO: 363 - protein, 116 aa, Artificial Sequence
  Description of Artificial Sequence: Synthetic polypeptide
EVQLSESGGGLVQPGGSLRLSCAASGFTFKRYEMMWVRQAPGKGLEWVSSISSDGSFTYYADSVKGRFTISRDNSKNTLYLQMNSLRAEDTAVYYCADPFTEFDYWGQGTLVTVSS

SEQ ID NO: 364 - protein, 116 aa, Artificial Sequence
  Description of Artificial Sequence: Synthetic polypeptide
EVQLLESGGGLVQPGGSLRLSCAASGFTFKRYEMMWVRQTPGKGLEWVSSISSDGSFTYYADSVKGRFTISRDNSKNTLYLQMNSLRAEDTAVYYCAEPFTEFDYWGQGTLVTVSS

SEQ ID NO: 365 - protein, 116 aa, Artificial Sequence
  Description of Artificial Sequence: Synthetic polypeptide
EVQLLESGGGLVQPGGSLRLSCAASGFTFKRYEMMWVRQAPGKGLEWVSSISSDGSFTYYADSVKGRFTISRDNSKNTLYLEMNSMRAEDTAVYYCAEPFTEFDNWGQGTLVTVSS

SEQ ID NO: 366 - protein, 116 aa, Artificial Sequence
  Description of Artificial Sequence: Synthetic polypeptide
EVQLLESGGGLVQPGGSLRLSCAASGFTFKRYEMMWVRQAPGKGLEWVSSISSDGSFTYYADSVKGRFTISRDNSKNTLYLQMNSLRAEDTAVYYCAEPFTEFDYWGQGTQVTVSS

SEQ ID NO: 367 - protein, 116 aa, Artificial Sequence
  Description of Artificial Sequence: Synthetic polypeptide
EVQLLESGGGLVQPGGSLRLSCAASGFNFKRYEMTWVRQAPGKGLEWVSSISSDGSFTYYADSVKGRFTISRDNSKNTLYLQMNSLRAEDTAVYYCADPFTEFDYWGQGTLVTVSS

SEQ ID NO: 368 - protein, 116 aa, Artificial Sequence
  Description of Artificial Sequence: Synthetic polypeptide
EVQLLESGGDLVQPGGSLRLSCAASGFTFKRYEMMWVRQAPGKGLEWVSSISSDGSFTYYADSVKGRFTISRDNSKNTLYLQMNSLRAEDTAVYYCAEPFTEFDYRGQGTLVTVSS

SEQ ID NO: 369 - protein, 116 aa, Artificial Sequence
  Description of Artificial Sequence: Synthetic polypeptide
EVQLLESGGGLVQPGGSLRLSCAASGFTFKRYEMSWVRQAPGKGLEWVSSISSDGSFTYYADSVKGRFTISRDNSKNTLYLQMNSLRAEDTAVYYCAEPFTEFDYWGRGTLVTVSS

SEQ ID NO: 370 - protein, 124 aa, Artificial Sequence
  Description of Artificial Sequence: Synthetic polypeptide
EVQLLESGGGLVQPGGSLRLSCAASGFTFEAYPMSWVRQAPGKGLEWVSSISPLGLWTYYADSVKGRFTISRDNSKNTLYLQMNSLRAEDTAVYYCAKLSAGAETHVYRLFDYWGQGTLVTVSS

SEQ ID NO: 371 - protein, 122 aa, Artificial Sequence
  Description of Artificial Sequence: Synthetic polypeptide
EVQLLESGGGLVQPGGSLRLSCAASGFTFGNYEMMWVRQAPGKGLEWVSSIGVLGHTTYYADSVKGRFTISRDNSKNTLYLQMNSLRAEDTAVYYCAKLMSLRTFENLFDYWGQGTLVTVSS

SEQ ID NO: 372 - protein, 121 aa, Artificial Sequence
  Description of Artificial Sequence: Synthetic polypeptide
EVQLLESGGGLVQPGGSLRLSCAASGFTFTKYPMAWVRQAPGKGLEWVSGIDANGNRTYYADSVKGRFTISRDNSKNTLYLQMNSLRAEDTAVYYCAEGTWRRHFAIFDYWGQGTLVTVSS

SEQ ID NO: 373 - protein, 123 aa, Artificial Sequence
  Description of Artificial Sequence: Synthetic polypeptide
EVQLLESGGGLVQPGGSLRLSCAASGFTFDLYDMMWVRQAPGKGLEWVSSISDLGTLTYYADSVKGRFTISRDNSKNTLYLQMNSLRAEDTAVYYCAKNGFRVTSNDRRFDYWGQGTLVTVSS

SEQ ID NO: 374 - protein, 119 aa, Artificial Sequence
  Description of Artificial Sequence: Synthetic polypeptide
EVQLLESGGGLVQPGGSLRLSCAASGFTFTGGDMWWVRQAPGKGLEWVSMIEGGGVTTYYADSVKGRFTISRDNSKNTLYLQMNSLRAEDTAVYYCAELDLRTGQFDYWGQGTLVTVSS

SEQ ID NO: 375 - protein, 118 aa, Artificial Sequence
  Description of Artificial Sequence: Synthetic polypeptide
EVQLLESGGGLVQPGGSLRLSCAASGFTFSAYTMGWVRQAPGKGLEWVSLIGDRGSWTYYADSVKGRFTISRDNSKNTLYLQMNSLRAEDTAVYYCAEPSDPTKFDYWGQGTLVTVSS

SEQ ID NO: 376 - protein, 118 aa, Artificial Sequence
  Description of Artificial Sequence: Synthetic polypeptide
EVQLLESGGGLVQPGGSLHLSCAASGFTFSAYTMGWVRQAPGKGLEWVSLIGDRGSWTYYADSVKGRFTISRDNSKNTLYLQMNSLRAEDTAVYFCADPSDPTKFDYWGQGTLVTVSS

SEQ ID NO: 377 - protein, 118 aa, Artificial Sequence
  Description of Artificial Sequence: Synthetic polypeptide
EVQLLESGGGLVQPGGSLRLSCAASGFTFSAYTMGWVRQAPGKGLEWVSLIGDRGSWTYYADSVKGRFTISRDNSKNTLYLQMNSLRAEDTAVYYCADPSDPTKFDYWGQGTLVTVSS

SEQ ID NO: 378 - protein, 118 aa, Artificial Sequence
  Description of Artificial Sequence: Synthetic polypeptide
EVQLLESGGGLVQPGGSLRLSCAASGFTFSAYTMGWVRQAPGKGLEWVSLIGDRGSWTYYADSVKGRFTISRDNSKNTLYLQMSSLRAEDTAVYYCADPSDPTKFDYWGQGTLVTVSS

SEQ ID NO: 379 - protein, 118 aa, Artificial Sequence
  Description of Artificial Sequence: Synthetic polypeptide
EVQLLESGGGLVQPGGSLRLSCAASGFTFPAYTMGWVRQAPGKGLEWVSLIGDRGSWTYYADSVKGRFTISRDDSKNTLYLQMNSLRVEDTAVYYCAEPSDPTMFVYWGQGTLVTVSS

SEQ ID NO: 380 - protein, 118 aa, Artificial Sequence
  Description of Artificial Sequence: Synthetic polypeptide
EVQLLESGGGLVQPGGSLRLSCAASGFTFSAYTMGWVRQAPGKGLEWVSLIGDRGSWTYYADSVKGRFTISRDNSKNTLYLQMNSLRAEDTAVYYCAEPSDPTMFVYWGQGTLVTVSS

SEQ ID NO: 381 - protein, 118 aa, Artificial Sequence
  Description of Artificial Sequence: Synthetic polypeptide
EVQLLESGGGLVQPGGSLRLSCAASGFTFSAYTMGWVRQAPGKGLEWVSLIGDRGSWTYYADSVKGRFTISRDNSKNTLYLQMNSLRAEDTAVYYCADPSDPTMFDYWGQGTLVTVSS

SEQ ID NO: 382 - protein, 118 aa, Artificial Sequence
  Description of Artificial Sequence: Synthetic polypeptide
EVQLLESGGGMVQPGGSLRLSCAASGFTFSAYTMGWVRQAPGKGLEWVSLIGDRGSWTYYADSVKGRFTISRDNSKNTLYLQMNSMRAEDTAVYYCADPSDPTKFDYWGQGTLVTVSS

SEQ ID NO: 383 - protein, 118 aa, Artificial Sequence
  Description of Artificial Sequence: Synthetic polypeptide
EVQLLESGGGLVQPGGSLRLSCAASGFTFSAYTMGWVRQAPGKGLEWVTLIGDRGSWTYYADSVKGRFTISRDNSKNTLYLQMNSLRAEDTAVYYCAEPSDPTMFDYWGQGTLVTVSS

SEQ ID NO: 384 - protein, 118 aa, Artificial Sequence
  Description of Artificial Sequence: Synthetic polypeptide
EVQLLESGGGLVQPGGSLRLSCAASGFTFTAYTMGWVRQAPGKGLEWVSLIGDRGSWTYYADSVKGRFTISRDNSKNTLYLQMNSLRAEDTAVYYCAEPSDPTKLDYWGQGTLVTVSS

SEQ ID NO: 385 - protein, 118 aa, Artificial Sequence
  Description of Artificial Sequence: Synthetic polypeptide
EVQLSESGGGLVQPGGSLRLTCAASGFTFSAYTMGWVRQAPGKGLEWVSLIGDRGSWTYYADSVKGRFTISRDNSKNTLYLQMNSLRAEDTAVYYCADPSDPTKFVYWGQGTLVTVSS

SEQ ID NO: 386 - protein, 118 aa, Artificial Sequence
  Description of Artificial Sequence: Synthetic polypeptide
EVQLLESGGGLVQPGGSLRLSCAASGFTFSAYTMGWVRQAPGKGLEWVSLIGDRGSWTYYADSVKGRFTISRDNSKNTLYLQMNSLRAEDTAVYYCADPSDPTKFVYWGQGTLVTVSS

SEQ ID NO: 387 - protein, 118 aa, Artificial Sequence
  Description of Artificial Sequence: Synthetic polypeptide
EVQLLESGGGLVQPGGSLRLSCAASGFTFSAYTMGWVRQAPGKGLEWVSLIGDRGSWTYYADSVKGRFTISRDNSKNTLYLQMNSLRAEDTAVYYCAEPSDPTKFVYWGQGTPVTVSS

SEQ ID NO: 388 - protein, 117 aa, Artificial Sequence
  Description of Artificial Sequence: Synthetic polypeptide
VQLLESGGGLVQPGGSLRLSCAASGFTFSAYTMGWVRQAPGKGLEWVSLIGDRGSWTYYADSVKGRFTISRDNSRNMLYLQMKSLRAEDTAVYYCADPSDPTKFVYWGQGTQVTVSS

SEQ ID NO: 389 - protein, 118 aa, Artificial Sequence
  Description of Artificial Sequence: Synthetic polypeptide
EVQLLESGGGLVQPGGSLRLSCAASGFTFSAYTMGWVRQAPGKGLEWVSLIGDRGSWTYYADSVKGRFTIFRDNSKNTLYLQMNSLRAEDTAVYYCADPSDPTKFVYWGQGTLVTVSS

SEQ ID NO: 390 - protein, 118 aa, Artificial Sequence
  Description of Artificial Sequence: Synthetic polypeptide
EVQLLESGGGLLQPGGSLRLSCAASGFTFSDYTMGWVRQAPGKGLEWVSLIGDRGSWTYYADSVKGRFTISRDNSKNTLYLQMNSLRAEDTAVYYCAEPSDPTKFDYWGRGTLVTVSS

SEQ ID NO: 391 - protein, 118 aa, Artificial Sequence
  Description of Artificial Sequence: Synthetic polypeptide
EVQLLESGGGLVQPGGSLRLSCAASGFTFSAYTMGWVRQAPGKGLEWVSLIGDRGSWTYYADSVKGRFTISRDNSKNTLYLQMNSLRAEDTAVYYCAEPSDPTKFVYWGQGTLVTVSS

SEQ ID NO: 392 - protein, 118 aa, Artificial Sequence
  Description of Artificial Sequence: Synthetic polypeptide
EVQLLESGGGLVQPGGSLRLSCAASGFTFSAYTMGWVRQAPGKGLEWVSLIGDRGTWTYYADPVKGRFTISRDNSKNTLYLQMNSLRAEDTAVYYCADPSDPTKFDYWGQGTLVTVSS

SEQ ID NO: 393 - protein, 118 aa, Artificial Sequence
  Description of Artificial Sequence: Synthetic polypeptide
EVQLLESGGGLVQPGGSLRLSCAASGFTFSAYTMGWVRQAPGKGLEWVSLIGDRGSWTYYADSVKGRFTVSRDNSKNTLYLQMNSLRAEDTAVYYCAEPSDPTKFDYWGQGTLVTVSS

SEQ ID NO: 394 - protein, 118 aa, Artificial Sequence
  Description of Artificial Sequence: Synthetic polypeptide
EVQLLESGGGLVQPGGSLRLSCAASGFTFSAYTMGWVRQAPGMGLEWVSLIGDRGSWTYYADSVKGRFTISRDNSKNTLYLQMNSLRAEDTAVYYCAEPSDPTKFDYWGQGTLVTVSS

SEQ ID NO: 395 - protein, 116 aa, Artificial Sequence
  Description of Artificial Sequence: Synthetic polypeptide
EVQLLESGGGLVQPGGSLRLSCAASGFTFDNYKMYWVRQAPGKGLEWVSSISEIGNLTYYADSVKGRFTISRDNSKNTLYLQMNSLRAEDTAVYYCAIALTRFDYWGQGTLVTVSS

SEQ ID NO: 396 - protein, 122 aa, Artificial Sequence
  Description of Artificial Sequence: Synthetic polypeptide
EVQLLESGGGLVQPGGSLRLSCAASGFTFASYRMYWVRQAPGKGLEWVSYIDPPGSRTYYADSVKGRFTISRDNSKNTLYLQMNSLRAEDTAVYYCAKSLNLSFPYINFDYWGQGTLVTVSS

SEQ ID NO: 397 - protein, 116 aa, Artificial Sequence
  Description of Artificial Sequence: Synthetic polypeptide
EVQLLESGGGLVQPGGSLRLSCAASGFTFERYEMLWVRQAPGKGLEWVSRISHSGRTTYYADSVKGRFTISRDNSKNTLYLQMNSLRAEDTAVYYCAQLDGPFDYWGQGTLVTVSS

SEQ ID NO: 398 - protein, 122 aa, Artificial Sequence
  Description of Artificial Sequence: Synthetic polypeptide
EVQLLESGGGLVQPGGSLRLSCAASGFTFKRYYMDWVRQAPGKGLEWVSRINHNGSVTYYADSVKGRFTISRDNSKNTLYLQMNSLRAEDTAVYYCAKMPQGTSDWYYFDYWGQGTLVTVSS

SEQ ID NO: 399 - protein, 116 aa, Artificial Sequence
  Description of Artificial Sequence: Synthetic polypeptide
EVQLLESGGGLVQPGGSLRLSCAASGFTFSKYDMSWVRQAPGKGLEWVSTILEDGLTTYYADSVKGRFTISRDNSKNTLYLQMNSLRAEDTAVYYCAKPGRLFDYWGQGTLVTVSS

SEQ ID NO: 400 - protein, 116 aa, Artificial Sequence
  Description of Artificial Sequence: Synthetic polypeptide
EVQLLESGGGLVQPGGSLRLSCAASGFTFSDYPMTWVRQAPGKGLEWVSTILSPGTETYYADSVKGRFTISRDNSKNTLYLQMNSLRAEDTAVYYCAKAEKDFDYWGQGTLVTVSS

SEQ ID NO: 401 - protein, 116 aa, Artificial Sequence
  Description of Artificial Sequence: Synthetic polypeptide
EVQLLESGGGLVQPGGSLRLSCAASGFTFEGGEMGWVRQAPGKGLEWVSMIPMDGSATYYADSVKGRFTISRDNSKNTLYLQMNSLRAEDTAVYYCAKAGEVFDYWGQGTLVTVSS

SEQ ID NO: 402 - protein, 116 aa, Artificial Sequence
  Description of Artificial Sequence: Synthetic polypeptide
EVQLLESGGGLVQPGGSLRLSCAASGFTFREYHMKWARQAPGKGLEWVSGISRDGMNTYYADSVKGRFTISRDNSKNTLYLQMNSLRAEDTAVYYCAIQLALFDYWGQGTLVTVSS

SEQ ID NO: 403 - protein, 121 aa, Artificial Sequence
  Description of Artificial Sequence: Synthetic polypeptide
EVQLLESGGGLVQPGGSLRLSCAASGFTFRDYEMLWARQAPGKGLEWVSGILPSGGATYYADSVKGRFTISRDNSKNTLYLQMNSLRAEDTAVYYCAKAGSGNGPILFDYWGQGTLVTVSS

SEQ ID NO: 404 - protein, 122 aa, Artificial Sequence
  Description of Artificial Sequence: Synthetic polypeptide
EVQLLESGGGLVQPGGSLRLSCAASGFTFKEHDMFWVRQAPGKGLEWVSGIGAEGVWTYYADSVKGRFTISRDNSKNTLYLQMNSLRAEDTAVYYCAEPTMSNGSQSRFDYWGQGTLVTVSS

SEQ ID NO: 405 - protein, 123 aa, Artificial Sequence
  Description of Artificial Sequence: Synthetic polypeptide
EVQLLESGGGLVQPGGSLRLSCAASGFTFDNTEMAWVRQAPGKGLEWVSGIIEDGNRTYYADSVKGRFTISRDNSKNTLYLQMNSLRAEDTAVYYCAKIRNLHWDVGRQFDYWGQGTLVTVSS

SEQ ID NO: 406 - protein, 123 aa, Artificial Sequence
  Description of Artificial Sequence: Synthetic polypeptide
EVQLLESGGGLVQPGGSLRLSCAASGFTFDNTEMAWVRQAPGKGLEWVSGITEDGNRTYYADSVKGRFTISRDNSKNTLYLQMNSLRAEDTAVYYCAKIRNLHWDVGRQFDYWGQGTLVTVSS

SEQ ID NO: 407 - protein, 123 aa, Artificial Sequence
  Description of Artificial Sequence: Synthetic polypeptide
EVQLLESGGGLVQPGGSLRLSCAASGFTFDNTEMAWVRQAPGKGLEWVSGITEDGNRTYYADSVKGRFTISRDNSKNTLYLQMNNLRAEDTAVYYCAKIRNLHWDVGRQFDYWGQGTLVTVSS

SEQ ID NO: 408 - protein, 123 aa, Artificial Sequence
  Description of Artificial Sequence: Synthetic polypeptide
EVQLLESGGGLVQPGGSLRLSCAASGFTFDNTEMAWIRQAPGKGLEWVSGITEDGNRTYYADSVKGRFTISRDNFKNTLYLQMNSLRAEDTAVYYCAKIRNLHWDVGRQFDYWGQGTLVTVSS

SEQ ID NO: 409 - protein, 123 aa, Artificial Sequence
  Description of Artificial Sequence: Synthetic polypeptide
EVQLLESGGGLVQPGGSLRLSCAASGFTFDNTEMAWVRQAPGKGLEWVSGITEDGNRTYYADSVKGRFTISRDNSMNTLYLQMNSLRAEDTAVYYCAKIRNLHWDVGRQFVYWGQGTLVTVSS

SEQ ID NO: 410 - protein, 123 aa, Artificial Sequence
  Description of Artificial Sequence: Synthetic polypeptide
EVQLLESGGGLVQPGGSLRLSCAASGFTFDNTEMAWIRQAPGKGLEWVSGIIEDGNRTYYADSVKGRFTISRDNSKNTLYLQMNSLRAEDTAVYYCAKIRNLHWDVGRQFDYWGQGTLVTVSS

SEQ ID NO: 411 - protein, 123 aa, Artificial Sequence
  Description of Artificial Sequence: Synthetic polypeptide
EVQLLESGGGLVQPGGSLRLSCAASGFTFDNTEMAWIRQAPGKGLEWVSGITEDGNRTYYADSVKGRFTISRDNSKNTLYLQMNSLRAEDTAVYYCAKIRNLHWDVGRQFDYWGQGTLVTVSS

SEQ ID NO: 412 - protein, 123 aa, Artificial Sequence
  Description of Artificial Sequence: Synthetic polypeptide
EVQLLESGGGLVQPGGSLRLSCAASGFTFDNTEMAWIRQAPGKGLEWVSGITEDGNRTYYADSVKGRFTISRDNSKNALYLQMNSLRAEDTAVYYCAKIRNLHWDVGRQFDYWGLGTLVTVSS

SEQ ID NO: 413 - protein, 123 aa, Artificial Sequence
  Description of Artificial Sequence: Synthetic polypeptide
EVQLLESGGGLVQPGGSLRLSCAASGFTFDNTEMAWVRQAPGKGLEWVSGITEDGNRTYYADSVKGRFTISRDNTKNTLYLQMNSLRAEDTAVYYCAKIRNLHWDVGRQFVYWGQGTLVTVSS

SEQ ID NO: 414 - protein, 123 aa, Artificial Sequence
  Description of Artificial Sequence: Synthetic polypeptide
EVQLLESGGGLVQPGGSLRLSCAASGFTFDNTEMAWIRQAPGKGLEWVSGIIEDGNRTYYADSVKGRFTISRDNSKNRLYLQMNSLRAEDTAVYYCAKIRNLHWDVGRQFDYWGQGTLVTVSS

SEQ ID NO: 415 - protein, 123 aa, Artificial Sequence
  Description of Artificial Sequence: Synthetic polypeptide
EVQLLESGGGLVQPGGSLRLSCAASGFTFDNTEMAWVRQAPGKGLEWVSGITEDGNRTYYADSVKGRFTISRDNSKNTLYLQMNSLRAEDTAVYHCAKIRNLHWDVGRQFDYWGQGTLVTVSS

SEQ ID NO: 416 - protein, 123 aa, Artificial Sequence
  Description of Artificial Sequence: Synthetic polypeptide
EVQLLESGGGLVQPEGSLRLSCAASGFTFDNTEMAWVRQAPGKGLEWVSGIIEDGNRTYYADSVKGRFTISRDNSKNTLYLQMNSLRAEDTAVYYCAKIRNLHWDVGRQFDYWGQGTLVTVSS

SEQ ID NO: 417 - protein, 123 aa, Artificial Sequence
  Description of Artificial Sequence: Synthetic polypeptide
EVQLLESGGGLVQPGGSLRLSCAASGFTFDNTEMAWVRQAPGKGLEWVSGISEDGNRTYYADSVKGRFTISRDNSKNTLYLQMNSLRAEDSAVYYCAKIRNLHWDVGRQFVYWGQGTLVTVSS

SEQ ID NO: 418 - protein, 123 aa, Artificial Sequence
  Description of Artificial Sequence: Synthetic polypeptide
EVQLLESGGGLVEPGGSLRLSCAASGFTFDNTEMAWVRQAPGKGLEWVSGITEDGNRTYYADSVKGRFTISRDNSKNTLYLQMSSLRAEDTAVYYCAKIRNLHWDVGRQFDYWGQGTLVTVSS

SEQ ID NO: 419 - protein, 123 aa, Artificial Sequence
  Description of Artificial Sequence: Synthetic polypeptide
EVQLLESGGGLVQPGGSLRLSCAASGFTFDNTEMAWVRQAPGKGLEWVSGISEDGNRTYYADSVKGRFTISRDNSKNTLYLQMNSLRAEDTAVYHCAKIRNLHWDVGRQFDYWGQGTLVTVSS

SEQ ID NO: 420 - protein, 123 aa, Artificial Sequence
  Description of Artificial Sequence: Synthetic polypeptide
EVQLLESGGGLVQPGGSLRLSCAASGFTFDNTEMAWVRQAPGKGLEWVSGITEDGNRTYYADSVKGRFIISRDNSKNTLNLQMNSLRAEDTAVYYCAKIRNLHWDVGRQFDYWGQGTLVTVSS

SEQ ID NO: 421 - protein, 123 aa, Artificial Sequence
  Description of Artificial Sequence: Synthetic polypeptide
EVQLLESGGGLVQPGGSLRLSCAASGFTFDNTEMAWIRQAPGRGLEWVSGVTEDGNRTYYADSVKGRFTISRDNSKNTLYLQMNSLRAEDTAVYYCAKIRNLHWDVGRQFDYWGQGTLVTVSS

SEQ ID NO: 422 - protein, 123 aa, Artificial Sequence
  Description of Artificial Sequence: Synthetic polypeptide
EVQLLESGGGLVQPGGSLRLSCEASGFTFDNTEMAWIRQAPGKGLEWVSGIIEDGNRTYYADSVKGRFTISRDNTKNTLYLQMNSLRAEDTAVYYCAKIRNLHWDVGRQFDYWGQGTLVTVSS

SEQ ID NO: 423 - protein, 123 aa, Artificial Sequence
  Description of Artificial Sequence: Synthetic polypeptide
EVQLLESGGGLVQPGGSLRLSCAASGFTFDNTEMAWIRQAPGKGLEWVSGITEDGDRTYYADSVKGRFTISRDNSKSSLYLQMNSLRAEDTAVYYCAKIRNLHWDVGRQFDYWGQGTLVTVSS

SEQ ID NO: 424 - protein, 123 aa, Artificial Sequence
  Description of Artificial Sequence: Synthetic polypeptide
EVQLLESGGGSVQPGGSLRLSCAASGFTFDNTEMAWVRQAPGKGLEWVSGITEDGNRTYYADSVKGRFTISRDNSKNTLYLQMNSLRAEDTAVYYCAKIRNLHWDVGRQFVYWGQGTLVTVSS

SEQ ID NO: 425 - protein, 123 aa, Artificial Sequence
  Description of Artificial Sequence: Synthetic polypeptide
EVQLLESGGGLVQPGGSLRLSCAASGFTFGSAEMGWVRQAPGKGLEWVSGISRPGQVTYYADSVKGRFTISRDNSKNTLYLQMNSLRAEDTAVYYCAKIRNLHWDVGRQFDYWGQGTLVTVSS

SEQ ID NO: 426 - protein, 119 aa, Artificial Sequence
  Description of Artificial Sequence: Synthetic polypeptide
EVQLLESGGGLVQPGGSLRLSCAASGFTFDDGTMGWARQAPGKGLEWVSLILPSGSRTYYADSVKGRFTISRDNSKNTLYLQMNSLRAEDTAVYYCAKHSLTNRPFDYWGQGTLVTVSS

SEQ ID NO: 427 - protein, 116 aa, Artificial Sequence
  Description of Artificial Sequence: Synthetic polypeptide
EVQLLESGGGLVQPGGSLRLSCAASGFTFSKYDMRWARQAPGKGLEWVSDIDAVGTRTYYADSVKGRFTISRDNSKNTLYLQMNSLRAEDTAVYYCAIPGGTFDYWGQGTLVTVSS

SEQ ID NO: 428 - protein, 116 aa, Artificial Sequence
  Description of Artificial Sequence: Synthetic polypeptide
EVQLLESGGGLVQPGGSLRLSCAASGFTFEMYGMMWARQAPGKGLEWVSSIEGAGHATYYADSVKGRFTISRDNSKNTLYLQMNSLRAEDTAVYYCAIVLGMFDYWGQGTLVTVSS

SEQ ID NO: 429 - protein, 124 aa, Artificial Sequence
  Description of Artificial Sequence: Synthetic polypeptide
EVQLLESGGGLVQPGGSLRLSCAASGFTFLQYPMGWVRQAPGKGLEWVSTISPVGLTTYYADSVKGRFTISRDNSKNTLYLQMNSLRAEDTAVYYCAKLFEGSRIQRDVGFDYWGQGTLVTVSS

SEQ ID NO: 430 - protein, 123 aa, Artificial Sequence
  Description of Artificial Sequence: Synthetic polypeptide
EVQLLESGGGLVQPGGSLRLSCAASGFTFEKYQMGWARQAPGKGLEWVSSIRGSGLVTYYADSVKGRFTISRDNSKNTLYLQMNSLRAEDTAVYYCAKVHTTLHTEVIGFDYWGQGTLVTVSS

SEQ ID NO: 431 - protein, 116 aa, Artificial Sequence
  Description of Artificial Sequence: Synthetic polypeptide
EVQLLESGGGLVQPGGSLRLSCAASGFTFSQYTMYWARQAPGKGLEWVSEISHSGSNTYYADSVKGRFTISRDNSKNTLYLQMNSLRAEDTAVYYCAISGLHFDYWGQGTLVTVSS

SEQ ID NO: 432 - protein, 120 aa, Artificial Sequence
  Description of Artificial Sequence: Synthetic polypeptide
EVQLLESGGGLVQPGGSLRLSCAASGFTFSDYAMAWVRQAPGKGLEWVSRIGVEGGDTYYADSVKGRFTISRDNSKNTLYLQMNSLRAEDTAVYYCAKLLRLYRLGFDYWGQGTLVTVSS

SEQ ID NO: 433 - protein, 121 aa, Artificial Sequence
  Description of Artificial Sequence: Synthetic polypeptide
EVQLLESGGGLVQPGGSLRLSCAASGFTFAKYDMTWVRQAPGKGLEWVSKINSDGGLTYYADSVKGRFTISRDNSKNTLYLQMNSLRAEDTAVYYCAKGLHGRGFVIFDYWGQGTLVTVSS

SEQ ID NO: 434 - protein, 124 aa, Artificial Sequence
  Description of Artificial Sequence: Synthetic polypeptide
EVQLLESGGGLVQPGGSLRLSCAASGFTFSRYDMVWVRQAPGKGLEWVSRINSMGLATYYADSVKGRFTISRDNSKNTLYLQMNSLRAEDTAVYYCAKDYSVAPHGYPLGFDYWGQGTLVTVSS

SEQ ID NO: 435 - protein, 122 aa, Artificial Sequence
  Description of Artificial Sequence: Synthetic polypeptide
EVQLLESGGGLVQPGGSLRLSCAASGFTFKDYSMMWVRQAPGKGLEWVSTITDNGTSTYYADSVKGRFTISRDNSKNTLYLQMNSLRAEDTAVYYCAKHMSLATYLQFFDYWGQGTLVTVSS

SEQ ID NO: 436 - protein, 123 aa, Artificial Sequence
  Description of Artificial Sequence: Synthetic polypeptide
EVQLLESGGGLVQPGGSLRLSCAASGFTFMEYDMLWVRQAPGKALEWVSRISSDGLWTYYADSVKGRFTISRDNSKNTLYLQMNSLRAEDTAVYYCAKGVSALAPFDIGFDYWGQGTLVTVSS

SEQ ID NO: 437 - protein, 121 aa, Artificial Sequence
  Description of Artificial Sequence: Synthetic polypeptide
EVQLLESGGGLVQPGGSLRLSCAASGFTFKEYNMAWVRQAPGKGLEWVSSINFAGRTTYYADSVKGRFTISRDNSKNTLYLQMNSLRAEDTAVYYCAKLSLPLDIFSFDYWGQGTLVTVSS

SEQ ID NO: 438 - protein, 116 aa, Artificial Sequence
  Description of Artificial Sequence: Synthetic polypeptide
EVQLLESGGGLVQPGGSLRLSCAASGFTFGDYGMNWVRQAPGKGLEWVSHISSNGRFTYYADSVKGRFTISRDNSKNTLYLQMNSLRAEDTAVYYCAETSGYFDYWGQGTLVTVSS

SEQ ID NO: 439 - protein, 116 aa, Artificial Sequence
  Description of Artificial Sequence: Synthetic polypeptide
EVQLLESGGGLVQPGGSLRLSCAASGFTFGDYGMNWVRQAPGKGLEWVSHISSNGRFTYYADSVKGRFTISRDNSKNMLYLRMNSLRAEDTAVYYCAETSGYYEYWGQGTLVTVSS

SEQ ID NO: 440 - protein, 116 aa, Artificial Sequence
  Description of Artificial Sequence: Synthetic polypeptide
EVQLLESGGGLVQPGGSLRLSCAASGFTFGDYGMNWVRQAPGKGLEWVSHISSNGRFTYYADSVKGRFTISRDNSKNTLYLQMNSLRAEDTAVYYCAETSGYFEYWGQGTLVTVSS

SEQ ID NO: 441 - protein, 116 aa, Artificial Sequence
  Description of Artificial Sequence: Synthetic polypeptide
EVQLLESGGGLVQPGGSLRLSCAASGFTFGDYGMNWVRQAPGKGLEWVSHISSNGRFTYYADSVKGRFTISRDNSKNTLYLQMNSLRAEDTAVYYCAETSSYFEYWGQGTLVTVSS

SEQ ID NO: 442 - protein, 116 aa, Artificial Sequence
  Description of Artificial Sequence: Synthetic polypeptide
EVQLLESGGGLVQPGGSLRLSCAASGFTFGDYGMNWVRQAPGKGLEWVSHISSNGRFTYYADSVKGRFTISRDNSKNTLFLQMNSLRAEDTAVYYCAETSGYYEYWGHGTLVTVSS

SEQ ID NO: 443 - protein, 116 aa, Artificial Sequence
  Description of Artificial Sequence: Synthetic polypeptide
EVQLLESGGGLVQPGGSLRLSCAASGFAFGDYGMNWVRQAPGKGLEWVSHISSNGRFTYYADSVKGRFTISRDNSKNTLYLQMNSLRAEDTAVYYCAETSGYFEYWGQGTLVTVSS

SEQ ID NO: 444 - protein, 116 aa, Artificial Sequence
  Description of Artificial Sequence: Synthetic polypeptide
EVQLLESGGGLVQPGGSLRLSCAASGFTFGDYGMNWVRQAPGKGLEWVSHISSNGRFIYYADSVKGRFTISRDNSKNTLYLQMNSLRAEDTAVYYCAETSGYFEYWGQGTLVTVSS

SEQ ID NO: 445 - protein, 116 aa, Artificial Sequence
  Description of Artificial Sequence: Synthetic polypeptide
EVQLLESGGGLVQPGGSLRLSCAASGFTFREYVMGWVRQAPGKGLEWVSTINGLGNVTYYADSVKGRFTISRDNTKNTLYLQMNSLRAEETAVYYCAIQLPNFDYWGQGTLVTVSS

SEQ ID NO: 446 - protein, 119 aa, Artificial Sequence
  Description of Artificial Sequence: Synthetic polypeptide
EVQLLESGGGLVQPGGSLRLSCAASGFTFGNDGMWWVRQAPGKGLEWVSFINVDGRETYYADSVKGRFTISRDNSKNTLYLQMNSLRAEDTAVYYCAEWSPGRVQFDYWGQGTLVTVSS

SEQ ID NO: 447 - protein, 119 aa, Artificial Sequence
  Description of Artificial Sequence: Synthetic polypeptide
EVQLLESGGGLVQPGGSLRLSCAASGFTFGGWDMAWVRQAPGKGLEWVSSIAHEGGETYYADSVKGRFTISRDNSKNTLYLQMNSLRAEDTAVYYCAKYVPGSPLFDYWGQRTLVTVSS

SEQ ID NO: 448 - protein, 116 aa, Artificial Sequence
  Description of Artificial Sequence: Synthetic polypeptide
EVQLLESGGGLVQPGGSLRLSCAASGFTFDQGWMYWVRQAPGKGLEWVSGIGSNGPRTSYADSVKGRFTISRDNSKNTLYLQMNSLRAEDTAVYYCAKSGEYFDYWGQGTLVTVSS

SEQ ID NO: 449 - protein, 117 aa, Artificial Sequence
  Description of Artificial Sequence: Synthetic polypeptide
EVQLLESGGGLVQPGGSLRLSCAASGFTFRQSDMWWVRQAPGKGLEWVSVIGNNGEFTYYADSVKGRFTISRDNSKNTLYLQMNSLRAEDTAVYYCAKDNWLLFDYWGQGTLVTVSS

SEQ ID NO: 450 - protein, 116 aa, Artificial Sequence
  Description of Artificial Sequence: Synthetic polypeptide
EVQLLESGGGLVQPGGSLRLSCAASGFTFDLSTMYWVRQAPGKGLEWVSTIGGDGSHTYYADSVKGRFTISRDNSKNTLYLQMNSLRAEDTAVYYCAEGTQYFDYWGQGTLVTVSS

SEQ ID NO: 451 - protein, 116 aa, Artificial Sequence
  Description of Artificial Sequence: Synthetic polypeptide
EVQLLESGGGLVQPGGSLRLSCAASGFTFSAYTMEWVRQAPGKGLEWVSSIGVTGYDTYYADSVKGRFTISRDNSKNTLYLQMNSLRAEDTAVYYCAKGGQGFDYWGQGTLVTVSS

SEQ ID NO: 452 - protein, 124 aa, Artificial Sequence
  Description of Artificial Sequence: Synthetic polypeptide
EVQLLESGGGLVQPGGSLRLSCAASGFTFGDYGMSWVRQAPGKGLEWVSYIDPLGRLTYYADSVKGRFTISRDNSKNTLYLQMNSLRAEDTAVYYCAEDLSSLQYGVSPNFDYWGQGTLVTVSS

SEQ ID NO: 453 - protein, 121 aa, Artificial Sequence
  Description of Artificial Sequence: Synthetic polypeptide
EVQLLESGGGLVQPGGSLRLSCAASGFTFFHYSMSWVRQAPGKGLEWVSSIGPVGRETYYADSVKGRFTISRDNSKNTLYLQMNSLRAEDTAVYYCAKMIQSPLFKDFDYWGQGTLVTVSS

SEQ ID NO: 454 - protein, 120 aa, Artificial Sequence
  Description of Artificial Sequence: Synthetic polypeptide
EVQLLESGGGLVQPGGSLRLSCAASGFTFEWYDMYWVRQAPGKGLEWVSRIDSGGNQTYYADSVKGRFTISRDNSKNTLYLQMNSLRAEDTAVYYCAEASLWKWRLFDYWGQGTLVTVSS

SEQ ID NO: 455 - protein, 122 aa, Artificial Sequence
  Description of Artificial Sequence: Synthetic polypeptide
EVQLLESGGGLVQPGGSLRLSCAASGFTFEEYGMAWVRQAPGKGLEWVSTISPLGISTYYADSVKGRFTISRDNSKNTLYLQMNSLRAEDTAVYYCAKHATSQESLRSFDYWGQGTLVTVSS

SEQ ID NO: 456 - protein, 123 aa, Artificial Sequence
  Description of Artificial Sequence: Synthetic polypeptide
EVQLLESGGGLVQPGGSLRLSCAASGFTFSKYEMMWVRQAPGKGLEWVSAISGSGGSTYYADSVKGRFTISRDNSKNTLYLQMNSLRAEDTAVYYCAKGPLPDAFWTRGFDYWGQGTLVTVSS

SEQ ID NO: 457 - protein, 121 aa, Artificial Sequence
  Description of Artificial Sequence: Synthetic polypeptide
EVQLLESGGGLVQPGGSLRLSCAASGFTFGTYSMAWVRQAPGKGLEWVSTIDRHGLATYYADSVKGRFTISRDNSKNTLYLQMNSLRAEDTAVYYCAKTPGSSWQTVFGYWGQGTLVTVSS

SEQ ID NO: 458 - protein, 121 aa, Artificial Sequence
  Description of Artificial Sequence: Synthetic polypeptide
EVQLLESGGGLVQPGGSLRLSCAASGFTFESYPMGWVRQAPGKGLEWVSSIDHHGHSTYYADSAKGRFTISRDNSKNTLYLQMNSLRAEDTAVYYCAKLLRVSMIFGFDYWGQGTLVTVSS

SEQ ID NO: 459 - protein, 116 aa, Artificial Sequence
  Description of Artificial Sequence: Synthetic polypeptide
EVQLLESGGGLVQPGGSLRLSCAASGFTFVQYGMSWVRQAPGKGLEWVSWISSSGTYTYYADSVKGRFTISRDNSKNTLYLQMNSLRAEDTAVYYCAETSRMFDYWGQGTLVTVSS

SEQ ID NO: 460 - protein, 121 aa, Artificial Sequence
  Description of Artificial Sequence: Synthetic polypeptide
EVQLLESGGGLVQPGGSLRLSCAASGFTFREYDMGWVRQAPGKGLEWVSLISPPGRTTYYADSVKGRFTISRDNSKNTLYLQMNSLRAEDTAVYYCAKVVILGYTNRFDYWGQGTLVTVSS

SEQ ID NO: 461 - protein, 124 aa, Artificial Sequence
  Description of Artificial Sequence: Synthetic polypeptide
EVQLLESGGGLVQPGGSLRLSCAASGFTFPNYGMLWVRQAPGKGLEWVSSINSSGMETYYADSVKGRFTISRDNSKNTLYLQMNSLRAEDTAVYYCAKFFRLNDHNSVFGFDYWGQGTLVTVSS

SEQ ID NO: 462 - protein, 116 aa, Artificial Sequence
  Description of Artificial Sequence: Synthetic polypeptide
EVQLLESGGGLVQPGGSLRLSCAASGFTFKDYKMMWIRQAPGKGLEWVSSIVGSGSMTYYADSVKGRFTISRDNSKNTLYLQMNSLRAEDTAVYYCAKGPGYFDYWGQGTLVTVSS

SEQ ID NO: 463 - protein, 120 aa, Artificial Sequence
  Description of Artificial Sequence: Synthetic polypeptide
EVQLLESGGGLVQPGGSLRLSCAASGFTFHNYAMGWVRRAPGKGLEWVSSIDEHGTITYYADSVKGRFTISRDNSKNTLYLQMNSLRAEDTAVYYCAKDSLDRVWIFDYWGQGTLVTVSS

SEQ ID NO: 464 - protein, 122 aa, Artificial Sequence
  Description of Artificial Sequence: Synthetic polypeptide
EVQLLESGGGLVQPGGSLRLSCAASGFTFADYPMTWVRQAPGKGLEWVSSIYSAGSPTYYADSVKGRFTISRDNSKNTLYLQMNSLRAEDTAVYYCAKLYHREPILFGFDYWGQGTLVTVSS

SEQ ID NO: 465 - protein, 116 aa, Artificial Sequence
  Description of Artificial Sequence: Synthetic polypeptide
EVQLLESGGGLVQPGGSLRLSCAASGFTFERYQMAWVRQAPGKGLEWVSTISSDGGGTYYADSVKGRFTISRDNSKNTLYLQMNSLRAEDTAVYYCAKPGHRFDYWGQGTLVTVSS

SEQ ID NO: 466 - protein, 119 aa, Artificial Sequence
  Description of Artificial Sequence: Synthetic polypeptide
EVQLLESGGGLVQPGGSLRLSCAASGFTFGSYTMMWVRQAPGKGLEWVSEIDRTGERTYYADSVKGRFTISRDNSKNTLYLQMNSLRAEDTAVYYCAEPGFASLPFDYWGQGTLVTVSS

SEQ ID NO: 467 - protein, 116 aa, Artificial Sequence
  Description of Artificial Sequence: Synthetic polypeptide
EVQLLESGGGLVQPGGSLRLSCAASGFTFTDYTMYWVRQAPGKGLEWVSKISPSGRSTYYADSVKGRFTISRDNSKNTLYLQMNSLRAEDTAVYYCAKDPFGFDYWGQGTLVTVSS

SEQ ID NO: 468 - protein, 119 aa, Artificial Sequence
  Description of Artificial Sequence: Synthetic polypeptide
EVQLLESGGGLVQPGGSLRLSCAASGFTFDDAEMFWVRQAPGKGLEWVSSIDARGLTTYYADPVKGRFTISRDNSKNTLYLQMNSLRAEDTAVYYCAEATSAMYPFDYWGQGTLVTVSS

SEQ ID NO: 469 - protein, 121 aa, Artificial Sequence
  Description of Artificial Sequence: Synthetic polypeptide
EVQLLESGGGLVQPGGSLRLSCAASGFTFRDYDMGWVRQAPGKGLEWVSTISPLGHFTYYADSVKGRFTISRDNSKNTLYLQMNSLRAEDTAVYYCAKSGFHEYTEGFDYWGQGTLVTVSS

SEQ ID NO: 470 - protein, 123 aa, Artificial Sequence
  Description of Artificial Sequence: Synthetic polypeptide
EVQLLESGGGLVQPGGSLRLSCAASGFTFDRAGMGWVRQAPGKGLEWVSLIGRGGDITYYADSVKGRFTISRDNSKNTLYLQMNSLRAEDTAVYYCAKIRNLHWDVGRQFDYWGQGTLVTVSS

SEQ ID NO: 471 - protein, 116 aa, Artificial Sequence
  Description of Artificial Sequence: Synthetic polypeptide
EVQLLESGGGLVQPGGSLRLSCAASGFTFGRYQMAWVRQAPGKGLEWVSSISSDGGGTYYADSVKGRFTISRDNSKNTLYLQMNSLRAEDTAVYYCAKPSRRFDYWGQGTLVTVSS

SEQ ID NO: 472 - protein, 123 aa, Artificial Sequence
  Description of Artificial Sequence: Synthetic polypeptide
EVQLLESGGGLVQPGGFLRLSCAASGFTFELYPMAWVRQAPGKGLEWVSSISPVGFLTYYADSVKGRFTISRDNSKNTLYLQMNSLRAEDTAVYYCAKGHEGSYTPRSAFDYWGQGTLVTVSS

SEQ ID NO: 473 - protein, 123 aa, Artificial Sequence
  Description of Artificial Sequence: Synthetic polypeptide
EVQLLESGGGLVQPGGSLRLSCAASGFTFVAYPMAWVRQAPGKGLEWVSTIAPLGGNTYYADSVKGRFTISRDNSKNTLYLQMNSLRAEDTAVYYCAKRPEGLQIDSQNFDYWGQGTLVTVSS

SEQ ID NO: 474 - protein, 116 aa, Artificial Sequence
  Description of Artificial Sequence: Synthetic polypeptide
EVQLLESGGGLVQPGGSLRLSCAASGFTFALYQMAWVRQAPGKGLEWVSSIDSSGSDTYYADSVKGRFTISRDNSKNTLYLQMNSLRAEDTAVYYCAKPERDFDYWGQGTLVTVSS

SEQ ID NO: 475 - protein, 116 aa, Artificial Sequence
  Description of Artificial Sequence: Synthetic polypeptide
EVQLLESGGGLVQPGGSLRLSCAASGFTFRQYQMAWARQAPGKGLEWVSTIASDGVSTYYADSVKGRFTISRDNSKNTLYLQMNSLRAEDTAVYYCAKVGRDFDYWGQGTLVTVSS

SEQ ID NO: 476 - protein, 116 aa, Artificial Sequence
  Description of Artificial Sequence: Synthetic polypeptide
EVQLLESGGGLVQPGGSLRLSCAASGFTFEQYDMRWVRQAPGKGLEWVSWIDEAGHETYYADSVKGRFTISRDNSRNTLYLQMNSLRAEDTAVYYCAKGMDGFDYWGQGTLVTVSS

SEQ ID NO: 477 - protein, 123 aa, Artificial Sequence
  Description of Artificial Sequence: Synthetic polypeptide
EVQLLESGGGLVQPGGSLRLSCAASGFTFVDYPMGWVRQAPGKGLEWVSTISTGGFSTYYADSVKGRFTISRDNSKNTLYLQMNSLRAEDTAVYYCAKARYYYLSQIKNFDYWGQGTLVTVSS

SEQ ID NO: 478 - protein, 120 aa, Artificial Sequence
  Description of Artificial Sequence: Synthetic polypeptide
EVQLLESGGGLVQPGGSLRLSCAASGFTFDIYGMTWVRQAPGKGLEWVSSISPLGLVTYYADPVKGRFTISRDNSKNTLYLQMNSLRAEDTAVYYCAKLKEHGDVPFDYWGQGTLVTVSS

SEQ ID NO: 479 - protein, 123 aa, Artificial Sequence
  Description of Artificial Sequence: Synthetic polypeptide
EVQLLESGGGLVQPGGSLRLSCAASGFTFELYPMSWVRQAPGKGLEWVSTISPTGLLTYYADSVKGRFTISRDNSKNTLYLQMNSLRAEDTAVYYCAKFKRSGKTDDTNFDYWGQGTLVTVSS

SEQ ID NO: 480 - protein, 116 aa, Artificial Sequence
  Description of Artificial Sequence: Synthetic polypeptide
EVQLLESGGGLVQPGGSLRLSCAASGFTFREYDMLWVRQAPGKGLEWVSTIVGDGNGTYYADSVKGRFTISRDNSKNTLYLQMNSLRAEDTAVYYCAKQDRQFDYWGQGTLVTVSS

SEQ ID NO: 481 - protein, 120 aa, Artificial Sequence
  Description of Artificial Sequence: Synthetic polypeptide
EVQLLESGGGLVQPGGSLRLSCAASGFTFEEYGMSWVRQAPGKGLEWVSTISPIGVTTYYADSVKGRFTISRDNSKNTLYLQMNSLRAEDTAVYYCAKNAYDRKSNFDYWGQGTLVTVSS

SEQ ID NO: 482 - protein, 124 aa, Artificial Sequence
  Description of Artificial Sequence: Synthetic polypeptide
EVQLLESGGGLVQPGGSLRLSCAASGFTFDRYVMVWVRQAPGKDLEWVSGITPSGRRTYYADSVKGRFTISRDNSKDTLYLQMNSLRAEDTAVYYCAKVLGRHFDPLLPSFDYWGQGTLVTVSS

SEQ ID NO: 483 - protein, 123 aa, Artificial Sequence
  Description of Artificial Sequence: Synthetic polypeptide
EVQLLESGGGLVQPGGSLRLSCAASGFTFEDYAMSWVRQAPGKGLEWVSTITPGGFWTYYADSVKGRFTISRDNSKNTLYLQMNSLRAEDTAVYYCAKTSSGELQLVEDFDYWGQGTLVTVSS

SEQ ID NO: 484 - DNA, 351 bp, Artificial Sequence
  Description of Artificial Sequence: Synthetic polynucleotide
gaggtgcagctgttggagtctgggggaggcttagtacagcctggggggtccctgcgtctctcctgtgcagcctccggattcacctttattgcttatgatatgagttgggtccgccaggctccagggaagggtctggagtgggtctcatggattgatgagtggggtctgcagacatactacgcagactccgtgaagggccggttcaccatctcccgcgacaattccaagaacacgctgtatctgcaaatgaacagcctgcgtgccgaggacaccgcggtatattactgtgcgaaaaagacgcctgaggagtttgactactggggtcagggaaccctggtcaccgtctcgagc

SEQ ID NO: 485 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttggtgattatgagatgagttgggtccgccaggctccagggaagggtctagagtgggtctcagggattgatggtgagggttctgatacatactacgcagactccgtgaagggccggttcaccatctcccgcgacaattccaagaacacgctgtatctgcaaatgaacagcctgcgtgccgaggataccgcggtatattactgtgcgaaaccggggaggagttttgactactggggtcagggaaccctggtcaccgtctcgagc

SEQ ID NO: 486 - DNA, 372 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgagcgttatcctatgacgtgggtccgccaggctccagggaagggtctagagtgggtctcaacgattcatggttctggtagtgctacatactacgcagactccgtgaagggccggttcaccatctcccgcgacaattccaagaacacgctgtatctgcaaatgaacagcctgcgtgccgaggacaccgcggtatattactgtgcgaaagggccgtatactagtcggcataatagtcttgggcattttgactactggggtcagggaaccctggtcaccgtctcgagc

SEQ ID NO: 487 - DNA, 369 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttatggattatcctatggggtgggtccgccaggctccagggaagggtctagagtgggtctcatctattgggcctgttggtatgagtacatactacgcagactccgtgaagggccggttcaccatctcccgcgacaattccaagaacacgctgtatctgcaaatgaacagcctgcgtgccgaggataccgcggtatattactgtgcgaaatatggggggactagtggtaggcataatactaagtttgactactggggtcagggaaccctggtcaccgtctcgagc

SEQ ID NO: 488 - DNA, 369 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttactgagtatcctatgagttgggtccgccaggctccagggaagggtctagagtgggtctcagttatttctcctcttggttttacgacatactacgcagactccgtgaagggccggttcaccatctcccgcgacaattccaagaacacgctgtatctgcaaatgaacagcctgcgtgccgaggataccgcggtatattactgtgcgaaatggactggtgggagtggtattttgaattcttcttttgactactggggtcagggaaccctggtcaccgtctcgagc

SEQ ID NO: 489 - DNA, 369 bp, Artificial Sequence
  Description of Artificial Sequence: Synthetic polynucleotide
gaggtgcagctgttggagtctgggggaggcttggtacagcctggggggtccctgcgtctctcctgtgcagcctccggatttagggttagcaattacgatttgacctgggtccgccaggctccagggaagggtctagagtgggtatcaaccattagtgccacaaacggtagcacatactacgcagactccgtgaagggccggttcaccatctcccgtgacaattccaagaacacgctgtatctgcaaatgaacagcctgcgtgccgaggacaccgcggtatattattgcgcggcagtgacgtggtggttgttgcgtcataacgacaacttggggttttggggtcagggaaccctggtcaccgtctcgagc

SEQ ID NO: 490 - DNA, 363 bp, Artificial Sequence
  Description of Artificial Sequence: Synthetic polynucleotide
gaggtgcagctgttggagtctgggggaggcttggtacagcctggggggtccctgcgtctctcctgtgcagcctccggatttagcattagctataagaatatggcctgggtccgccaggctccagggaagggtctagagtgggtatcagccattaaggcggcaaacggtagcacatactacgcagactccgtgaagggccggttcaccatctcccgtgacaattccaagaacacgctgtatctgcaaatgaacagcctgcgtgccgaggacaccgcggtatattattgcgcgacagggagtcagaagaagcggacctacacgttcgacttttggggtcagggaaccctggtcaccgtctcgagc

SEQ ID NO: 491 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaggttgtatgagatggcgtgggtccgccaggctccagggaagggtctagagtgggtctcagggattgatattttgggttcgaggacatactacgcagactccgtgaagggccggttcaccatctcccgcgacaattccaagaacacgctgtatctgcaaatgaacagcctgcgtgccgaggataccgcggtatattactgtgcgaaagatctgtcgtggcagggttttgactactggggtcagggaaccctggtcaccgtctcgagc

SEQ ID NO: 492 - DNA, 369 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaggtcttatacgatgggttgggtccgccaggctccagggaagggtctagagtgggtctcatctattaatcctatgggttatcagacatactacgcagactccgtgaagggccggttcaccatctcccgcgacaattccaagaacacgctgtatctgcaaatgaacagcctgcgtgccgaggataccgcggtatattactgtgcgaaacatggggtggggaagggtactaagccgcataattttgactactggggtcagggaaccctggtcaccgtctcgagc

SEQ ID NO: 493 - DNA, 369 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgagctgtataggatgtcttgggtccgccaggctccagggaagggtctagagtgggtctcagagattagtggtagtggttttcctacatactacgcagactccgtgaagggccggttcaccatctcccgcgacaattccaagaacacgctgtatctgcaaatgaacagcctgcgtgccgaggacaccgcggtatattactgtgcgaaaagtctgcatgataagactcagcatcatcaggagtttgactactggggtcagggaaccctggtcaccgtctcgagc

SEQ ID NO: 494 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttattgagtatcctatgcggtgggtccgccaggctccagggaagggtctagagtgggtctcacttatttctccgtctggtgtgtttacatactacgcagactccgtgaagggccggttcaccatctcccgcgacaattccaagaacacgctgtatctgcaaatgaacagcctgcgtgccgaggacaccgcggtatattactgtgcgaaaggggatgagtctagtacttttgactactggggtcagggaaccctggtcaccgtctcgagc

SEQ ID NO: 495 - DNA, 372 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaagcggtatgatatggattgggtccgccaggctccagggaagggtctagagtgggtctcaacgattgggagttcgggttatccgacatactacgcagactccgtgaagggccggttcaccatctcccgcgacaattccaagaacacgctgtatctgcaaatgaacagcctgcgtgccgaggacaccgcggtatattactgtgcggaaaggatgcctggttattttcctgggtttgctcggcagtttgactactggggtcagggaaccctggtcaccgtctcgagc

SEQ ID NO: 496 - DNA, 372 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcaccttttggcggtatgctatggggtgggtccgccaggctccagggaagggtctagagtgggtctcaacgattaatgatgagggtcgggagacatactacgcagactccgtgaagggccggttcaccatctcccgcgacaattccaagaacacgctgtatctgcaaatgaacagcctgcgtgccgaggacaccgcggtatattactgtgcgaaaaagcgggtgtctagttctgtgaatgctccgtatgagtttgactactggggtcagggaaccctggtcaccgtctcgagc

SEQ ID NO: 497 - DNA, 369 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgcgaattatagtatgagttgggtccgccaggccccagggaagggtctagagtgggtctcatcgattgatcgtcttggtacgcatacatactacgcagactccgtgaagggccggttcaccatctcccgcgacaattccaagaatacgctgtatctgcaaatgaacagcctgcgtgccgaggataccgcggtatattactgtgcgaaagtgctggctgatcttattgctgggcatgcggagtttgactactggggtcagggaaccctggtcaccgtctcgagc

SEQ ID NO: 498 - DNA, 372 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttccgtcgtatgatatggcgtgggtccgccaggctccagggaagggtctagagtgggtctcagggatttcgaggtctggttctatgacatactacgcagactccgtgaagggccggttcaccatctcccgcgacaattccaagaacacgctgtatttgcaaatgaacagcctgcgtgccgaggacaccgcggtatattactgtgcgaaaggtgttgatgcgcatgtttattatatggagcctttttttgactactggggtcagggaaccctggtcaccgtctcgagc

SEQ ID NO: 499 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgagaggtatcagatggcgtgggtccgccaggctccagggaagggtctagagtgggtctcaacgattagttctgatggtggggggacatactacgcagactccgtgaagggccggttcaccatctcccgcgacaattccaagaacacgctgtatctgcaaatgaacagcctgcgtgccgaggacaccgcggtatattactgtgcgaaaccgggtactgtttttgactactggggtcagggaaccctggtcaccgtctcgagc

SEQ ID NO: 500 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacatttccgaagtatgagatggcgtgggtccgccaggctccagggaagggtctagagtgggtctcatctattgatggtgatggtaagtctacatactacgcagactccgtgaagggccggttcaccatctcccgcgacaattccaagaacacgctgtatctgcaaatgaacagcctgcgtgccgaggataccgcggtatattactgtgcgaaaccggatcagttttttgactactggggtcagggaaccctggtcaccgtctcgagc

SEQ ID NO: 501 - DNA, 369 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcaccttttcttattattcgatgtattgggtccgccaggctccagggaagggtctagagtgggtctcatcgatttcgccttttggttggggtacatactacgcagactccgtgaagggccggttcaccatctcccgcgacaattccaaggacacgctgtatctgcaaatgaacagcctgcgtgccgaggacaccgcggtatattactgtgcgaaatatggggagacgagtggtccgatttctgagaattttgactactggggtcagggaaccctggtcaccgtctcgagc

SEQ ID NO: 502 - DNA, 348 bp, Artificial Sequence
  Description of Artificial Sequence: Synthetic polynucleotide
gaggtgcagctgttggagtctgggggaggcttggtacagcctggggggtccctgcgtctctcctgtacagcctccggattcacctttgcgggttatcagatgtcgtgggtccgccaggctccagggaagggtctagagtgggtctcaagtattactaatgagggtgtttctacatactacgcagactccgtgaagggccggttcaccatctcccgcgacaattccaagaacacgctgtatctgcaaatgaacagcctgcgtgccgaggacaccgcggtatattactgtgcgaaaccggggaagtattttgactactggggtcagggaaccctggtcaccgtctcgagc

SEQ ID NO: 503 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttggggagtatgagatggtgtgggtccgccaggctccagggaagggtctggagtgggtctcatctattacgtcggatggtctgagtacatactacgcagactccgtgaagggccggttcaccatctcccgcgacaattccaagaacacgctgtatctgcaaatgaacagcctgcgtgctgaggacaccgcggtatattactgtgcgaaaccgggtattcgttttgactactggggtcagggaaccctggtcaccgtctcgagc

SEQ ID NO: 504 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgctgattatgatatggcttgggtccgccaggctccagggaagggtctagagtgggtctcaggtattgttgatgatggtcttatgacatactacgcagactccgtgaagggccggttcaccatctcccgcgacaattccaagaacacgctgtatctgcaaatgaacagcctgcgtgccgaggacaccgcggtatattactgtgcgaaaccggatgttgcttttgactactggggtcaggggaccctggtcaccgtctcgaac

SEQ ID NO: 505 - DNA, 369 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttattggttatgctatggcgtgggtccgccaggctccagggaagggtctagagtgggtctcaagtattggtcctttgggtgcgactacatactacgcagactccgtgaagggccggttcaccatctcccgcgacaattccaagaacacgctgtatctgcaaatgaacagcctgcgtgccgaggacaccgcggtatattactgtgcgaaattgcctgctggtacgagtagtcatagtgtggattttgactactggggtcagggaaccctggtcaccgtctcgagc

SEQ ID NO: 506 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgcggattatgagatgacttgggtccgccaggctccagggaagggtctagagtgggtctcatctattactagtgatggtgtttctacatactacgcagactccgtgaagggccggttcaccatctcccgcgacaattccaagaacacgctgtatctgcaaatgaacagcctgcgtgccgaggacaccgcggtatattactgtgcgaaaccgtcggttcagtttgactactggggtcagggaaccctggtcaccgtctcgagc

SEQ ID NO: 507 - DNA, 363 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgtaggtatgttatggggtgggtccgccaggctccagggaagggtctagagtgggtctcatggattgaggctgatggtcgtacgacatactacgcagactccgtgaagggccggttcaccatctcccgcgacaattccaagaacacgctgtatctgcaaatgaacagcctgcgtgccgaggacaccgcggtatattactgtgcgaaagggcttacggatcagcatgttattgagtttgactactggggtcagggaaccctggtcaccgtctcgagc

SEQ ID NO: 508 - DNA, 351 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgatggttatcgtatggggtgggtccgccaggctccagggaagggtctagagtgggtctcatcgattgctccggatggtaattatacatactacgcagactccgtgaagggccggttcaccatctcccgcgacaattccaagaacacgctgtatctgcaaatgaacagcctgcgtgccgaggacaccgcggtatattactgtgcgaaattttgggggatgcagtttgactactggggtcagggaaccctggtcaccgtctcgagc

SEQ ID NO: 509 - DNA, 360 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgcttcgtatccgatgggttgggtccgccaggctccagggaagggtctagagtgggtctcaagtattggtcctattggttttactacatactacgcagactccgtgaagggccggttcaccatctcccgcgacaattccaagaacacgctgtatctgcaaatgaacagcctgcgtgccgaggacaccgcggtatattactgtgcggaaatgaagtcgccttataagccgcagtttgactactggggtcagggaaccctggtcaccgtctcgagc

SEQ ID NO: 510 - DNA, 360 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttttggcttattggatggtttgggtccgccaggctccagggaagggtctagagtgggtctcatctatttctccgtcgggtacgcatacatactacgcagactccgtgaagggccggttcaccatctcccgcgacaattccaagaacacgctgtatctgcaaatgaacagcctgcgtgtcgaggacaccgcggtatattactgtgcgaaatatactgagccggggttgggttcttttgactactggggtcagggaaccctggtcaccgtctcgagc

SEQ ID NO: 511 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcaccttttcgaattatgagatggggtgggtccgccaggctccagggaagggtctagagtgggtctcagtgatttctgaggtgggttctctgacatactacgcagactccgtgaagggccggttcaccatctcccgcgacaattccaagaacacgctgtatctgcaaatgaacagcctgcgtgccgaggacaccgcggtatattactgtgcgaaacctcatgatagttcgattgggtttgactactggggtcagggaaccctggtcaccgtctcgagc

SEQ ID NO: 512 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcaccttttggtcttatgatatgacgtgggtccgccaggctccagggaagggtctagagtgggtctcatctattatggcttcgggtgatgatacatactacgcagactccgtgaagggccggttcaccatctcccgcgacaattccaagaacacgctgtatctgcaaatgaacagcctgcgtgccgaggataccgcggtatattactgtgcgaaatgggatcgggattttgactactggggtcagggaaccctggtcaccgtctcgagc

SEQ ID NO: 513 - DNA, 360 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgaggagtatgttatgtcgtgggtccgccaggctccagggaagggtctggagtgggtctcaactatttctcctattggtctgactacatactacgcagactccgtgaagggccggttcaccatctcccgcgacaattccaagaacacgctgtatctgcaaatgaacagcctgcgtgccgaggacaccgcggtatattactgtgcggaatttcctttgattattcttcctgattttgactactggggtcagggaaccctggtcaccgtctcgagc

SEQ ID NO: 514 - DNA, 369 bp, Artificial Sequence
  Description of Artificial Sequence: Synthetic polynucleotide
gaggtgcagctgttggagtctgggggaggcctggtacagcctggggggtccctgcgtctctcctgtgcagcctccggattcacctttatggagtatgcgatgatttgggtccgccaggctccagggaagggtctagagtgggtctcaattatttctccgcttggtttgtctacatactacgcagactccgtgaagggccggttcaccatctcccgcgacaattccaagaacacgctgtatctgcaaatgaacagcctgcgtgccgaggacaccgcggtatattactgtgcgaaatatcaggattcgtctgatagtcagtatacgaattttgactactggggtcagggaaccctggtcaccgtctcgagc

SEQ ID NO: 515 - DNA, 363 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgaggattatgggatggggtgggcccgccaggctccagggaagggtctagagtgggtctcaagtattggtcctctgggtctttggacatactacgcagactccgcgaagggccggttcaccatctcccgcgacaattccaagaacacgctgtatctgcaaatgaacagcctgcgtgccgaggacaccgcggtatattactgtgcgaaatctccgcttgagggtttgattacgaattttgactactggggtcagggaaccctggtcaccgtctcgagc

SEQ ID NO: 516 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgatgcgtatgagatggggtgggtccgccaggctccagggaagggtctagagtgggtctcaattattgattgggatggtaattctacatactacgcagactccgtgaagggccggttcaccatctcccgcgacaattccaagaacacgctgtatctgcaaatgaacagcctgcgtgccgaggataccgcggtatattactgtgcgaaacctggggataatgttggtatttttgactactggggtcagggaaccctggtcaccgtctcgagc

SEQ ID NO: 517 - DNA, 366 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttagtaattattatatggtgtgggtccgccaggctccagggaagggtctagagtgggtctcagcgattgatgagtggggttttgcgacatactacgcagactccgtgaagggccggttcaccatctcccgcgacaattccaagaacacgctgtatctgcaaatgaacagcctgcgtgccgaggacaccgcggtatattactgtgcgaaacattgggagtttacgtctgatacgtcgcgttttgactactggggtcagggaaccctggtcaccgtctcgagc

SEQ ID NO: 518 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgaggattttgatatggcttgggtccgccaggctccagggaagggtctagagtgggtctcatctattaatgatcagggttctctgacatactacgcagactccgtgaagggccggttcaccatctcccgcgacaattccaagaacacgctgtatctgcaaatgaacagcctgcgtgccgaggacaccgcggtatattactgtgcgaaaccggatcagttttttgactactggggtcagggaaccctggtcaccgtctcgagc

SEQ ID NO: 519 - DNA, 366 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttagtgcttatgatatgatgtgggtccgccaggctccagggaagggtctagagtgggtctcacggattagtcctcagggtcagcggacatactacgcagactccgtgaagggccggttcaccatctcccgcgacaattccaagaacacgctgtatctgcaaatgaacagcctgcgtgccgaggacaccgcggtatattactgtgcgaaaattcgtgggcagtcgcggattcctatgaggtttgactactggggtcagggaaccctggtcaccgtctcgagc

SEQ ID NO: 520 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcctgagtatgatatgacgtgggtccgccaggctccagggaagggtctggagtgggtctcatatattagttctgatggttattctacatactacgcagactccgtgaagggccggttcaccatctcccgcgacaattccaagaacacgctgtatctgcaaatgaacagcctgcgtgccgaggacaccgcggtatattactgtgcgaaaccgcatgggagtccgcgggagtttgactactggggtcagggaaccctggtcaccgtctcgagc

SEQ ID NO: 521 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttacggattatgagatggggtgggtccgccaggctccagggaagggtctagagtgggtctcaacgattactagtttgggtgagagtacatactacgcagactccgtgaagggccggttcaccatctcccgcgacaattccaagaacacgctgtatctgcaaatgaacagcctgcgtgccgaggacaccgcggtatattactgtgcgaaacctggtcgtatttttgactactggggtcagggaaccctggtcaccgtctcgagc

SEQ ID NO: 522 - DNA, 369 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgctttttatcctatgatgtgggtccgccaggctccagggaagggtctagagtgggtctcatggattgatgctacgggtacgaggacatactacgcagactccgtgaagggccggttcaccatctcccgcgacaattccaagaacacgctgtatctgcaaatgaacagcctgcgtgccgaggacaccgcggtatattactgtgcggaaggtaattatgggagttcgtatactatgggggtttttgactactggggtcagggaaccctggtcaccgtctcgagc

SEQ ID NO: 523 - DNA, 366 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgatgagtatccgatgtattgggtccgccaggctccagggaagggtctagagtgggtctcatcgattggtccttctggtccgaatacatactacgcagactccgtgaagggccggttcaccatctcccgcgacaattccaagaacacgctgtatctgcaaatgaacagcctgcgtgccgaggacaccgcggtatattactgtgcgaaatctccgtattttgatgttattcctagttattttgactactggggtcagggaaccctggtcaccgtctcgagc

SEQ ID NO: 524 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgcggattacggtatgggttgggtccgccaggctccagggaagggtctagagtgggtctcatctattcagtcgtcgggtttgcggacatactacgcagactccgtgaagggccggttcaccatctcccgcgacaattccaagaacacgctgtatctgcaaatgaacagcctgcgtgccgaggataccgcggtatattactgtgcgaaacgggctaattctcgtaggggttttgactactggggtcagggaaccctggtcaccgtctcgagc

SEQ ID NO: 525 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcaccttttctgattatgagatgatgtgggtccgccaggctccagggaagggtctagagtgggtctcatctattactagtcatggtgggtctacatactacgcagactccgtgaagggccggttcaccatctcccgcgacaattccaagaacacgctgtatctgcaaatgaacagcctgcgtgccgaggataccgcggtatattactgtgcgaaacctgataaggattttgactactggggtcagggaaccctggtcaccgtctcgagc

SEQ ID NO: 526 - DNA, 366 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgcgcattatccgatgtcgtgggtccgccaggctccagggaagggtctagagtgggtctcatcgattggtaggctgggtaatcgtacatactacgcagactccgtgaagggccggttcaccatctcccgcgacaattccaagaacacgctgtatctgcaaatgaacagcctgcgtgccgaggacaccgcggtatattactgtgcgaaacgtgctacgcctgtgccgattaagggtttgtttgactactggggtcagggaaccctggtcaccgtctcgagc

SEQ ID NO: 527 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggactcacctttgggaggtatgagatggcgtgggtccgccaggctccagggaagggtctagagtgggtctcaagtattgattcggatggttgggtgacatactacgcagactccgtgaagggccggttcaccatctcccgcgacaattccaagaacacgctgtatctgcaaatgaacagcctgcgtgccgaggacaccgcggtatattactgtgcgcaaccggattcgttgtttgactactggggtcagggaaccctggtcaccgtctcgagc

SEQ ID NO: 528 - DNA, 351 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcaccttttctagttattctatggtgtgggtccgccaggctccagggaagggtctagagtgggtctcaggtattaatcggggtggtactcgtacatactacgcagactccgtgaagggccggttcaccatctcccgcgacaattccaagaacacgctgtatctgcaaatgaacagcctgcgtgccgaggacaccgcggtatattactgtgcgaaaggttggaggagggggtttgactactggggtcagggaaccctggtcaccgtctcgagc

SEQ ID NO: 529 - DNA, 351 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttacgcgttataggatgtcttgggtccgccaggctccagggaagggtctggagtgggtctcagggatttcgagggatggttatcggacatactacgcagactccgtgaagggccggttcaccatctcccgcgacaattccaagaacacgctgtatctgcaaatgaacagcctgcgtgccgaggacaccgcggtatattactgtgcgaaaggtatgactgcgtcgtttgactactggggtcagggaaccctggtcaccgtctcgagc

SEQ ID NO: 530 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcagatgtatccgatggggtgggtccgccaggctccagggaagggtctagagtgggtctcaatgattgagccggctggtgatcttacatactacgcagactccgtgaagggccggttcaccatctcccgcgacaattccaagaacacgctgtatctgcaaatgaacagcctgcgtgccgaggacaccgcggtatattactgtgcgaaatatcaggagcagccttggtttgactactggggtcagggaaccctggtcaccgtctcgagc

SEQ ID NO: 531 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcccctttccgcagtatcagatggcgtgggtccgccaggctccagggaagggtctagagtgggtctcaatgattacttctgatggtcttgatacatattacgcagactccgtgaagggccggttcaccatctcccgcgacaattccaagaacacgctgtatctgcaaatgaacagcctgcgtgccgaggataccgcggtatattactgtgcgaaacctgagcctctttttgactactggggtcagggaaccctggtcaccgtctcgagc

SEQ ID NO: 532 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttagtatgtatgatatgcattgggtccgccaggctccagggaagggtctagagtgggtctcaacgattttgtctgatggtacggatacatactacgcagactccgtgaagggccggttcaccatctcccgcgacaattccaagaacacgctgtatctgcaaatgaacagcctgcgtgccgaggacaccgcggtatattactgtgcgaaatatggggctatgtttgactactggggtcagggaaccctggtcaccgtctcgagc

SEQ ID NO: 533 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaagttgtatccgatgacgtgggtccgccaggctccagggaagggtctagagtgggtctcatctattgatgcggggggtcatgagacatactacgcagactccgtgaagggccggttcaccatctcccgcgacaattccaagaacacgctgtatctgcaaatgaacagcctgcgtgccgaggataccgcggtatattactgtgcgaaagattggtgggattatctgtttgactactggggtcagggaaccctggtcaccgtctcgagc

SEQ ID NO: 534 - DNA, 351 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcaccttttcgcggtatccgatgagttgggtccgccaggctccagggaagggtctagagtgggtctcatctattaatcgttcgggtatgcggacatactacgcagactccgtgaagggccggttcaccatctcccgcgacaattccaagaacacgctgtatctgcaaatgaacagcctgcgtgccgaggacaccgcggtatattactgtgcggaagggcatcaggcgccgtttgactactggggtcagggaaccctggtcaccgtctcgagc

SEQ ID NO: 535 - DNA, 369 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttacggggtatgctatgtcttgggtccgccaggctccagggaagggtctagagtgggtctcaactattaatgcgaatggtattcggacatactacgccgactccgtgaagggccggttcaccatctcccgcgacaattccaagaacacgctgtatctgcaaatgaacggcctgcgtgccgaggacaccgcggtatattactgtgcgaaagggggggtttggaggtgggggactgggcataagtttgactactggggtcagggaaccctggtcaccgtctcgagc

SEQ ID NO: 536 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaagcagtatgatatgcggtgggtccgccaggctccagggaagggtctagagtgggtctcaacgatttcgcagaatggtactaagacatactacgcagactccgtgaagggccggttcaccatctcccgcgacaattccaagaacacgctgtatctgcaaatgaacagcctgcgtgccgaggacaccgcggtatattactgtgcgaaatcgaggactggtaggtattttgactactggggtcagggaaccctggtcaccgtctcgagc

SEQ ID NO: 537 - DNA, 369 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgggacttatgatatggggtgggtccgccaggctccagggaagggtctagagtgggtctcaaggattaattggcagggtgatcgtacatactacgcagactccgtgaagggccggttcaccatctcccgcgacaattccaagaacacgctgtatctgcaaatgaacagcctgcgtgccgaggacaccgcggtatattactgtgcgaaagcggggtttggtcattatgttgatggtcttgggtttgactactggggtcagggaaccctggtcaccgtctcgagc

SEQ ID NO: 538 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttagtgggtatgagatggcgtgggtccgccaggctccagggaagggtctagagtgggtctcatctattactgatatgggtgattctacatactacgcagactccgtgaagggccggttcaccatctcccgcgacaattccaagaacacgctgtatctgcaaatgaacagcctgcgtgccgaggacaccgcggtatattactgtgcgaaacctgggactgcgtttgactactggggtccgggaaccctggtcaccgtctcgagc

SEQ ID NO: 539 - DNA, 351 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgcgaagtataagatgtggtgggtccgccaggctccagggaagggtctagagtgggtctcaagtattactccgaagggtcattctacatactacgcagactccgtgaagggccggttcaccatctcccgcgacaattccaagaacacgctgtatctgcaaatgaacagcctgcgtgccgaggataccgcggtatattactgtgcgaaaaggccgatgactccgtttgactactggggtcagggaaccctggtcaccgtctcgagc

SEQ ID NO: 540 - DNA, 366 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgagcggtataatatgtcttgggtccgccaggctccagggaagggtctagagtgggtctcatctattcggccgcggggtgggaagacatactacgcagactccgtgaagggccggttcaccatctcccgcgacaattccaagaacacgctgtatctgcaaatgaacagcctgcgtgccgaggacaccgcggtatattactgtgcgaaatggcggcgggaggggtatactggttctaagtttgactactggggtcagggaaccctggtcaccgtctcgagc

SEQ ID NO: 541 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgagaggtatggtatgacttgggtccgccaggctccagggaagggtctggagtgggtctcaagtatttggccgaggggtcagaagacatactacgcagactccgtgaagggccggttcaccatctcccgcgacaattccaagaacacgctgtatctgcaaatgaacagcctgcgtgccgaggacaccgcggtatattactgtgcgaaagggaatagtcggtatgtttttgactactggggtcagggaaccctggtcaccgtctcgagc

SEQ ID NO: 542 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcaccttttctgattatgagatgatgtgggtccgccaggctccagggaagggtctagagtgggtctcaactattacttcggatggtatttctacatactacgcagactccgtgaagggccggttcaccatcttccgcgacaattccaagaacacgctgtatctgcaaatgaacagcctgcgtgccgaggataccgcggtatattactgtgcgaaaagtgggaggttttttgactactggggtcagggaaccctggtcaccgtctcgagc

SEQ ID NO: 543 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcaccttttcgggttatcagatggcttgggtccgccaggctccagggaagggtctagagtgggtctcaggtattagttcggagggtcttactacatactacgcagactccgtgaagggccggttcaccatctcccgcgacaattccaagaacacgctgtatctgcaaatgaacagcctgcgtgccgaggacaccgcggtatattactgtgcgaaattggggcgtaggtttgactactggggtcagggaaccctggtcaccgtctcgagc

SEQ ID NO: 544 - DNA, 360 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttactaattatagtatgggttgggtccgccaggctccagggaagggtctagagtgggtctcaactattcgtcctaatggtactaagacatactacgcagactccgtgaagggccggttcaccatctcccgcgacaattccaagaacacgctgtatctgcaaatgaacagcctgcgtgccgaggataccgcggtatattactgtgcgaaacggtcgtctgcgcatcttcagaggtttgactactggggtcagggaaccctggtcaccgtctcgagc

SEQ ID NO: 545 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttggtaattattcgatgggttgggtccgccaggctccagggaagggtctagagtgggtctcatcgattggtcgtcatggtgggcgtacatactacgcagactccgtgaagggccggttcaccatctcccgcgacaattccaagaacacgctgtatctgcaaatgaacagcctgcgtgccgaggacaccgcggtatattactgtgcgaaaaaggggagtacttatcctaggtttgactactggggtcagggaaccctggtcaccgtctcgagc

SEQ ID NO: 546 - DNA, 354 bp, Artificial Sequence
  Description of Artificial Sequence: Synthetic polynucleotide
gaggtgcagctgttggagtctgggggaggcttggtacagcctggggggtccctgcgtctctcctgtacagcctccggattcaccttttcgcattatgagatggggtgggtccgccaggctccagggaagggtctagagtgggtctcaagtattgagccttttggtggtgggacatactacgcagactccgtgaagggccggttcaccatctcccgcgacaattccaagaacacgctgtatctgcaaatgaacagcctgcgtgccgaggataccgcggtatattactgtgcgaaagtgtatcctcagggttcttttgactactggggtcagggaaccctggtcaccgtctcgagc

SEQ ID NO: 547 - DNA, 372 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttagtaattatactatggggtgggtccgtcaggctccagggaagggtctagagtgggtctcatctattcggcctgatggtaagattacatactacgcagactccgtgaagggccggttcaccatctcccgcgacaattccaagaacacgctgtatctgcaaatgaacagcctgcgtgccgaggacaccgcggtatattactgtgcggaagtttattcttcgtgtgcgatgtgtactccgcttttgtttgactactggggtcagggaaccctggtcaccgtctcgagc

SEQ ID NO: 548 - DNA, 369 bp, Artificial Sequence
  Description of Artificial Sequence: Synthetic polynucleotide
gaggtgcagctgttggagtctggggggggcttggtacagcctggggggtccctgcgtctctcctgtgcagcctccggattcacctttaagcggtattcgatggcgtgggtccgccaggctccagggaagggtctagagtgggtctcagatattgggccgaggggtttttcgacatactacgcagactccgtgaagggccggttcaccatctcccgcgacaattccaagaacacgctgtatctgcaaatgaacagcctgcgtgccgaggacaccgcggtatattactgtgcgaaagtgggtcgtggtcagcgtgatactagtcagccgtttgactactggggtcagggaaccctggtcaccgtctcgagc

SEQ ID NO: 549 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgcttcttatcagatggcttgggtccgccaggctccagggaagggtctagagtgggtctcagggattacttcgggtggtcttagtacgtactacgcagactccgtgaagggccggttcaccatctcccgcgacaattccaagaacacgctgtatctgcaaatgaacagcctgcgtgccgaggacaccgcggtatattactgtgcgaaaccggggaggggttttgactactggggtcagggaaccctggtcaccgtctcgagc

SEQ ID NO: 550 - DNA, 348 bp, Artificial Sequence
  Description of Artificial Sequence: Synthetic polynucleotide
gaggtgcagctgttggagtctgggggaggcttggtacagcctggtgggtccctgcgtctctcctgtgcagcctccggattcacctttgcttcttatgagatgacttgggtccgccaggctccagggaagggtctagagtgggtctcagggatttcttctgatggtctgtctacatactacgcagactccgtgaagggccggttcaccatctcccgcgacaattccaagaacacgctgtatctgcaaatgaacagcctgcgtgccgaggacaccgcggtatattactgtgcgaaaccgggggtgttgtttgactactggggtcagggaaccctggtcaccgtctcgagc

SEQ ID NO: 551 - DNA, 351 bp, Artificial Sequence
  Description of Artificial Sequence: Synthetic polynucleotide
gaggtgcagctgttggagtctgggggaggcttggtacagcctggggggtccctgcgtctctcctgtgcagcctctggattcacctttgataagtatttgatgtcgtgggtccgccaggctccagggaagggtctggagtgggtctcaggtattgagcctctgggtgatgttacatactacgcagactccgtgaagggccggttcaccatctcccgcgacaattccaagaacacgctgtatctgcaaatgaacagcctgcgtgccgaggacaccgcggtatattactgtgcgaaagaggcttcgggggattttgactactggggtcagggaaccctggtcaccgtctcgagc

SEQ ID NO: 552 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccgggttcacctttactgagtatgagatgtcttgggtccgccaggctccagggaagggtctagagtgggtctcaagtattgataatgtgggtagtagtacatactacgcagactccgtgaagggccggttcaccatctcccgcgacaattccaagaacacgctgtatctgcaaatgaacagcctgcgtgccgaggataccgcggtatattactgtgcgaaacctgggaagctttttgactactggggtcagggaaccctggtcaccgtctcgagc

SEQ ID NO: 553 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgctgattatgagatgtggtgggtccgccaggctccagggaagggtctagagtgggtctcagcgatttctaggcagggttttgctacatactacgcagactccgtgaaaggccggttcaccatctcccgcgacaattccaagaacacgctgtatctgcaaatgaacagcctgcgtgccgaggacaccgcggtatattactgtgcgaaagatctggagcgggatgattttgactactggggtcagggaaccctggtcaccgtctcgagc

SEQ ID NO: 554 - DNA, 360 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgcgaattatgagatggggtgggcccgccaggctccagggaagggtctagagtgggtctcagttatttctgagtggggttattctacatactacgcagactccgcgaagggccggttcaccatctcccgcgacaattccaagaacacgctgtatctgcaaatgaacagcctgcgtgccgaggacaccgcggtatattactgtgcgaaacttgtgggtgggactcagtatgagtttgactactggggtcagggaaccctggtcaccgtctcgagc

SEQ ID NO: 555 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcataattatgagatgtcgtgggtccgccaggctccagggaagggtctagagtgggtctcaagtatttcttcgggtggttcttctacatactacgcagactccgtgaagggccggttcaccatctcccgcgacaattccaagaacacgctgtatctgcaaatgaacagcctgcgtgccgaggacaccgcggtatattactgtgcgaaaccgggggttaagtttgactactggggtcagggaaccctggtcaccgtctcgagc

SEQ ID NO: 556 - DNA, 348 bp, Artificial Sequence
  Description of Artificial Sequence: Synthetic polynucleotide
gaggtgcagctgttggagtccgggggaggcttggtacagcctggggggtccctgcgtctctcctgtgcagcctccggattcacctttgggctgtatgagatgacgtgggtccgccaggctccagggaagggtctagagtgggtctcaagtattacgggtgatggtatttcgacatactacgcagactccgtgaagggccggttcaccatctcccgcgacaattccaggaacacgctgtatctgcaaatgaacagcctgcgtgccgaggacaccgcggtatattactgtgcgaaagctgggaggaagtttgactactggggtcagggaaccctggtcaccgtctcgagc

SEQ ID NO: 557 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttagtaattatcagatggcgtgggtccgccaggctccagggaagggtctagagtgggtctcaagtattactagtgagggtggttcgacatactacgcagactccgtgaagggccggttcaccatctcccgcgacaattccaagaacacactgtatctgcaaatgaacagcctgcgtgccgaggacaccgcggtatattactgtgcgaaaccgggtaagaattttgactactggggtcagggaaccctggtcaccgtctcgagc

SEQ ID NO: 558 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttagtgattatcagatggcgtgggttcgccaggctccagggaagggactagagtgggtctcaagtattactagtgagggtggttcgacatactacgcagactccgtgaagggccggttcaccatctcccgcgacaattccaagaacacagtgtatctgcaaatgaacagcctgcgtgccgaggacaccgcggtatattactgtgcgaaaccgggtaagaatttcgactactggggtcagggaaccctggtcaccgtctcgagc

SEQ ID NO: 559 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgataattatgagatgacgtgggtccgccaggctccagggaagggtctagagtgggtctcaactattacgtcgcagggtactagtacatactacgcagactccgtgaagggccggttcaccatctcccgcgacaattccaagaacacgctgtatctgcaaatgaacagcctgcgtgccgaggacaccgcggtatattactgtgcgaaacctgatcgttcttttgactactggggtcagggaaccctggtcaccgtctcgagc

SEQ ID NO: 560 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgtagttatgagatgacttgggtccgccaggctccagggaagggtctggagtgggtctcatctattacgtcggatggtggtactacatactacgcagactccgtgaagggccggttcaccatctcccgcgacaattccaagaacacgctgtatctgcaaatgaacagcctgcgtgccgaggacaccgcggtatattactgtgcgaaacctgataagacgtttgactactggggtcagggaaccctggtcaccgtctcgagc

SEQ ID NO: 561 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaatttgtatgagatgacttgggtccgccaggctccagggaagggtctagagtgggtctcatctattactagtgatggtgtttctacatactacgcagactccgtgaagggccggttcaccatctcccgcgacaattccaagaacacgctgtatctgcaaatgaacagcctgcgtgccgaggacaccgcggtatattactgtgcgaaaccggattctccgtttgactactggggtcagggaaccctggtcaccgtctcgagc

SEQ ID NO: 562 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgggcattatgatatggcttgggtccgccaggctccagggaagggtctagagtgggtctcaactattagtgataatggtaatgggacatactacgcagactccgtgaagggccggttcaccatctcccgcgacaattccaagaacacgctgtatctgcaaatgaacagcctgcgtgccgaggacaccgcggtatattactgtgcgaaaccggggcgtgattttgactactggggtcagggaaccctggtcaccgtctcgagc

SEQ ID NO: 563 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttggtcgttatcagatggcttgggtccgccaggctccagggaagggtctagagtgggtctcatctatttcttctgatggtggggggacatactacgcagactccgtgaagggccggttcaccatctcccgcgacaattccaagaacacgctgtatctgcaaatgaacagcctgcgtgccgaggataccgcggtatattactgtgcgaaacctgggcgggcgtttgactactggggtcagggaaccctggtcaccgtctcgagc

SEQ ID NO: 564 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgcgaggtatcagatggcttgggtccgccaggctccagggaagggtctggagtgggtctcaactatttctgatgatggtgattcgacatactacgcagactccgtgaagggccggttcaccatctcccgcgacaattccaagaacacgctgtatctgcaaatgaacagcctgcgtgccgaggacaccgcggtatattactgtgcgaaactggataagttgtttgactactggggtcagggaaccctggtcaccgtctcgagc

SEQ ID NO: 565 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgataatgatgagatgacgtgggtccgccaggctccagggaagggtctagagtgggtctcagctattgatacgacgggtgggcagacatactacgcagactccgtgaagggccggttcaccatctcccgcgacaattccaagaacacgctgtatctgcaaatgaacagcctgcgtgccgaggacaccgcggtatattactgtgcgaaacctggtaaggagtttgactactggggtcagggaaccctggtcaccgtctcgagc

SEQ ID NO: 566 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttggggagagtgagatgagttgggtccgccaggctccagggaagggtctagagtgggtctcaagtattcttgatgagggttctgggacatactacgcagactccgtgaagggccggttcaccatctcccgcgacaattccaagaacacgctgtatctgcaaatgaacagcctgcgtgccgaggacaccgcggtatattactgtgcgaaacctgataaggattttgactactggggtcagggaaccctggtcaccgtctcgagc

SEQ ID NO: 567 - DNA, 351 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttggggaggaggagatgagttgggtccgccaggctccagggaagggtctagagtgggtctcagcgattactgatgatggtgatgatacatactacgcagactccgtgaagggccggttcaccatctcccgcgacaattccaagaacacgctgtatctgcaaatgaacagcctgcgtgccgaggacaccgcggtatattactgtgcgaaacctaatgcgggtgcttttgactactggggtcagggaaccctggtcaccgtctcgagc

SEQ ID NO: 568 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgaggtgtatgatatggcttgggtccgccaggctccagggaagggtctagagtgggtctcagggattgttaatgatggttcttctacatactacgcagactccgtgaagggccggttcaccatctcccgcgacaattccaagaacacgctgtatctgcaaatgaacagcctgcgtgccgaggacaccgcggtatattactgtgcgaaacctgataaggattttgactactggggtcagggaaccctggtcaccgtctcgagc

SEQ ID NO: 569 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttggtaatacggagatgacttgggtccgccaggctccagggaagggtctagagtgggtctcatcgattgcggatgatggttctagtacatactacgcagactccgtgaagggccggttcaccatctcccgcgacaattccaagaacacgctgtatctgcaaatgaacagcctgcgtgccgaggacaccgcggtatattactgtgcgaaacctggtcaggcttttgactactggggtcagggaaccctggtcaccgtctcgagc

SEQ ID NO: 570 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgaggagtatcagatggcgtgggtccgccaggctccagggaagggtctagagtgggtctcaacgatttcggatgatggttcttcgacatactacgcagactccgtgaagggccggttcaccatctcccgcgacaattccaagaacacgctgtatctgcaaatgaacagcctgcgtgccgaggacaccgcggtatattactgtgcgaaacctgatctttattttgactactggggtcagggaaccctggtcaccgtctcgagc

SEQ ID NO: 571 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgaggtgtatcagatgggttgggtccgccaggctccagggaagggtctagagtgggtctcatttattgtgcctgggggtgatttgacatactacgcagactccgtgaagggccggttcaccatctcccgcgacaattccaagaacacgctgtatctgcaaatgaacagcctgcgtgccgaggacaccgcggtatattactgtgcggaaacgtggccggagtttgactactggggtcagggaaccctggtcaccgtctcgagc

SEQ ID NO: 572 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgataattatgagatgacgtgggtccgccaggctccagggaagggtctagagtgggtctcatctattacgagtgatggtacttcgacatactacgcagactccgtgaagggccggttcaccatctcccgcgacaattccaagaacacgctgtatctgcaaatgaacagcctgcgtgccgaggataccgcggtatattactgtgcgaaacctaatccgccgtttgactactggggtcagggaaccctggtcaccgtctcgagc

SEQ ID NO: 573 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaaggcgtatgatatgggttgggtccgccaggctccagggaagggtctagagtgggtctcacagattgggagggatggttcttttacatactacgcagactccgtgaagggccggttcaccatctcccgcgacaattccaagaacacgctgtatctgcaaatgaacagcctgcgtgccgaggacaccgcggtatattactgtgcgaaacctcgtcggtatgctatttttacttttgatcggggtcagggaaccctggtcaccgtctcgagc

SEQ ID NO: 574 - DNA, 363 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaagcagtatccgatggtgtgggtccgccaggctccagggaagggtctagagtgggtctcaacgatttctactaatggtgtgaggacatactacgcagactccgtgaagggccggttcaccatctcccgcgacaattccaagaacacgctgtatctgcaaatgaacagcctgcgtgccgaggataccgcggtatattactgtgcgaaatggacggatattatttcgtcttcggagtttgactactggggtcagggaaccctggtcaccgtctcgagc

SEQ ID NO: 575 - DNA, 369 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcaccttttttaattatgatatgtcttgggtccgccaggctccagggaagggtctagagtgggtctcagctattagtggtagtggtggtagcacatactacgcagactccgtgaagggccggttcaccatctcccgcgacaattccaagaacacgctgtatctgcaaatgaacagcctgcgtgccgaggacaccgcggtatattactgtgcgaaagtttttgtgtggtcggctgatattgattttgattttgactactggggtcagggaaccctggtcaccgtctcgagc

SEQ ID NO: 576 - DNA, 369 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcaccttttcgtggtatgatatgagttgggtccgccaggctccagggaagggtctagagtgggtctcacatattgcgagttggggtggtaagacatactacgcagactccgtgaagggccggttcaccatctcccgcgacaattccaagaacacgctgtatctgcaaatgaacagcctgcgtgccgaggacaccgcggtatattactgtgcgaaagtgacggtgaaggatggggggtatctgatggattttgactactggggtcagggaaccctggtcaccgtctcgagc

SEQ ID NO: 577 - DNA, 366 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgctgagtatgctatggcgtgggtccgccaggctccagggaagggtctggagtgggtctcaagtattgggcgggatggtgcggtgacatactacgcagactccgtgaagggccggttcaccatctcccgcgacaattccaagaacacgctgtatctgcaaatgaacagcctgcgtgccgaggacaccgcggtatattactgtgcgaaatggaaggcggcgaaggagcggggttcttggtttgactactggggtcagggaaccctggtcaccgtctcgagc

SEQ ID NO: 578 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcaggcttatcagatgcagtgggtccgccaggctccagggaagggtcttgagtgggtctcaactattagtcctaatggtctttttacatactacgcagactccgtgaagggccggttcaccatctcccgcgacaattccaagaacacgctgtatctgcaaatgaacagcctgcgtgccgaggacaccgcggtatattactgtgcgaaatggttgagttcttttgactactggggtcagggaaccctggtcaccgtctcgagc

SEQ ID NO: 579 - DNA, 360 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgctatgtattcgatggcttgggtccgccaggctccagggaagggtctagagtgggtctcaggtatttcgcctcgtggtgttgagacatactacgcagactccgtgaagggccggttcaccatctcccgcgacaattccaagaacacgctgtatctgcaaatgaacagcctgcgtgccgaggacaccgcggtatattactgtgcgaaaactaattggaatggtgtggatctgtttgactactggggtcagggaaccctggtcaccgtctcgagc

SEQ ID NO: 580 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcctacgtatatgatgagttgggtccgccaggctccagggaagggtctagagtgggtctcaactattaatacgaatggtcgtgatacatactacgcagactccgtgaagggccggttcaccatctcccgcgacaattccaagaacacgctgtatctgcaaatgaacagcctgcgtgccgaggacaccgcggtatattactgtgcgaaaggggatagtaatatgtcgttttttgactactggggtcagggaaccctggtcaccgtctcgagc

SEQ ID NO: 581 - DNA, 360 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgagggttattcgatgacgtgggtccgccaggctccagggaagggtctagagtgggtctcatctattaatgcgtcgggtactctgacatactacgcagactccgtgaagggccggttcaccatctcccgcgacaattccaagaacacgctgtatctgcaaatgaacagcctgcgtgccgaggacaccgcggtatattactgtgcgaaagatggtaataggtctgaggttttttttgactactggggtcagggaaccctggtcaccgtctcgagc

SEQ ID NO: 582 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcaccttttttgagtatgagatgacgtgggtccgccaggctccagggaagggtctagagtgggtctcatctattgcgaatgatggttcgactacatactacgcagactccgtgaagggccggttcaccatctcccgcgacaattccaagaacacgctgtatctgcaaatgaacagcctgcgtgccgaggacaccgcggtatattactgtgcgaaacctgatcggcagtttgactactggggtcagggaaccctggtcaccgtctcgagc

SEQ ID NO: 583 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcaggattatttgatggcgtgggtccgccaggctccagggaagggtctagagtgggtctcagagattaatcaggatggtactgttacatactacgcagactccgtgaagggccggttcaccatctcccgcgacaattccaagaacacgctgtatctgcaaatgaacagcctgcgtgccgaggacaccgcggtatattactgtgcggaaagttctccgtattttgactactggggtcagggaaccctggtcaccgtctcgagc

SEQ ID NO: 584 - DNA, 369 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgataattatgcgatgtcgtgggtccgccaggctccagggaagggtctagagtgggtctcatctattagtcgggatggtcatgtgacatactacgcagactccgtgaagggccggttcaccatctcccgcgacaattccaagaacacgctgtatctgcaaatgaacagcctgcgtgccgaggacaccgcggtatattactgtgcgaaactttcttctaagggggggacgtttgctagttcttttgactactggggtcagggaaccctggtcaccgtctcgagc

SEQ ID NO: 585 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttagtgctgttccgatgacgtgggtccgccaggctccagggaagggtctagagtgggtctcagcgattacggatgatggtcttcgtacatactacgcagactccgtgaagggccggttcaccatctcccgcgacaattccaagaacacgctgtatctgcaaatgaacagcctgcgtgccgaggacaccgcggtatattactgtgcgaaaggtcatatttatggggattattttgactactggggtcagggaaccctggtcaccgtctcgagc

SEQ ID NO: 586 - DNA, 369 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgagctttataggatgatgtgggtccgccaggctccagggaagggtctagagtgggtctcagctattagtagtgatggtgatactacatactacgcagactccgtgaagggccggttcaccatctcccgcgacaattccaagaacacgctgtatctgcaaatgaacagcctgcgtgccgaggacaccgcggtatattactgtgcggaacattggttgggtactacgttgtctttgagggattttgactactggggtcagggaaccctggtcaccgtctcgagc

SEQ ID NO: 587 - DNA, 369 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcaccttttatcgttatacgatggcgtgggtccgccaggctccagggaagggtctagagtgggtctcacagatttcgcctaggggtaatattacatactacgcagactccgtgaagggccggttcaccatctcccgcgacaattccaagaacacgctgtatctgcaaatgaacagcctgcgtgccgaggacaccgcggtatattactgtgcgaaaagtggtgtggcgggggcggagtcgcctgagtattttgactactggggtcagggaaccctggtcaccgtctcgagc

SEQ ID NO: 588 - DNA, 357 bp, Artificial Sequence
  Description of Artificial Sequence: Synthetic polynucleotide
gaggtgcagctgttggagtctgggggaggtttggtgcagcctggggggtccctgcgtctctcctgtgcagcctccggattcacctttttgggttattatatgagttggatccgccaggctccagggaagggtctagagtgggtctcaacgattgggccgattggtggtgggacatactacgcagactccgtgaagggccggttcaccatctcccgcgacaattccaagaacacgctgtatctgcaaatgaacagcctgcgtgccgaggacaccgcggtatattactgtgcgaaatctcagaatatttatggtccttttgactactggggtcagggaaccctggtcaccgtctcgagc

SEQ ID NO: 589 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgagcagtatgatatggcttgggtccgccaggctccagggaagggtctagagtgggtctcagagattagtcgtgatggtgggcggacatactacgcagactccgtgaagggccggttcaccatctcccgcgacaattccaagaacacgctgtatctgcaaatgaacagcctgcgtgccgaggacaccgcggtatattactgtgcggaagagtatccttattttgactactggggtcagggaaccctggtcaccgtctcgagc

SEQ ID NO: 590 - DNA, 363 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttccgcagtatagtatggtgtgggtccgccaggctccagggaagggtcttgagtgggtctcaactatttcgcctctgggttcttcgacatactacgcagactccgtgaagggccggttcaccatctcccgcgacaattccaagaacacgctgtatctgcaaatgaacagcctgcgtgccgaggataccgcggtatattactgtgcgaaaatgagtaagttgttgctgtcgagggagtttgactactggggtcagggaaccctggtcaccgtctcgagc

SEQ ID NO: 591 - DNA, 360 bp, Artificial Sequence; identical to SEQ ID NO: 579
  Description of Artificial Sequence: Synthetic polynucleotide

SEQ ID NO: 592 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttacgcgtcatggtatggcgtgggtccgccaggctccagggaagggtctagagtgggtctcaacgattacgcctactggtaatactacatactacgcagactccgtgaagggccggttcaccatctcccgcgacaattccaagaacacgctgtatctgcaaatgaacagcctgcgtgccgaggacaccgcggtatattactgtgcgaaagatgctcatgatgaggggtattttgactactggggtcagggaaccctggtcaccgtctcgagc

SEQ ID NO: 593 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttggtccgtatgagatgacttgggtccgccaggctccagggaagggtctagagtgggtctcatcgattgttggtgatggtctggatacatactacgcagactccgtgaagggccggttcaccatctcccgcgacaattccaagaacacgctgtatctgcaaatgaacagcctgcgtgccgaggacaccgcggtatattactgtgcgaaaccggatcgggtttttgactactggggtcagggaaccctggtcaccgtctcgagc

SEQ ID NO: 594 - DNA, 342 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttggtagtacgcctatgatgtgggtccgccaggctccagggaagggtctagagtgggtctcagagattagggatacgggtctggctacatactacgcagactccgtgaagggccggttcaccatctcccgcgacaattccaagaacacgctgtatctgcaaatgaacagcctgcgtgccgaggacaccgcggtatattactgtgcgagtgtttcgtttgactactggggtcagggaaccctggtcaccgtctcgagc

SEQ ID NO: 595 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcatctgggggatatgcattgggtccgccaggctccagggaagggtctagagtgggtctcatcgattagtgggacgggtcatactacatactacgcagactccgtgaagggccggttcaccatctcccgcgacaattccaagaacacgctgtatctgcaaatgaacagcctgcgtgccgaggataccgcggtatattactgtgcgaaacctatgaatgatcaggggtttgactactggggtcagggaaccctggtcaccgtctcgagc

SEQ ID NO: 596 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttatggatgaggatatgttgtgggtccgccaggctccagggaagggtctagagtgggtctcaaggattaattcgctgggtactcatacatactacgcagactccgtgaagggccgattcaccatctcccgcgacaattccaagaacacgctgtatctgcaaatgaacagcctgcgtgccgaggataccgcggtatattactgtgcgaaatcgtttatgatgtttgactactggggtcagggaaccctggtcaccgtctcgagc

SEQ ID NO: 597 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgtaattatcagatgcattgggtccgccaggctccagggaagggtctagagtgggtctcaggtattgatgcgactggtcgggcgacatactacgcagactccgtgaagggccggttcaccatctcccgcgacaattccaagaacacgctgtatctgcaaatgaacagcctgcgtgccgaggacaccgcggtatattactgtgcgagatctactaggtcatttgactactggggtcagggaaccctggtcaccgtctcgagc

SEQ ID NO: 598 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttacgaatgcggatatggtgtgggtccgccaggctccagggaagggtctagagtgggtctcaagtattagtggtagtggtggtagcacatactacgcagactccgtgaagggccggttcaccatctcccgcgacaattccaagaacacgctgtatctgcaaatgaacagcctgcgtgccgaggacaccgcggtatattactgtgcgaaaggttatttgacttcgcattttgactactggggtcagggaaccctggtcaccgtctcgagc

SEQ ID NO: 599 - DNA, 360 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttagggattattctatggcttgggtccgccaggctccagggaagggtctagagtgggtctcaactattactccgtcgggtcttacgacatactacgcagactccgtgaagggccggttcaccatctcccgcgacaattccaagaacacgctgtatctgcaaatgaacagcctgcgtgccgaggacaccgcggtatattactgtgcggaatggtctcaggcggttactcggtcttttgactactggggtcagggaaccctggtcaccgtctcgagc

SEQ ID NO: 600 - DNA, 348 bp, Artificial Sequence
  Description of Artificial Sequence: Synthetic polynucleotide
gaggtgcagctgttggagtctgggggagacttggtacagcctggggggtccctgcgtctctcctgtgcagcctccggattcaccttttctgatgagggtatgatgtgggtccgccaggctccagggaagggtctagagtgggtctcagagattaatcagcagggttcggcgacatactacgcagactccgtgaagggccggttcaccatctcccgcgacaattccaagaacacgctgtatctgcaaatgaacagcctgcgtgccgaggacaccgcggtatattactgtgcgaaaacgattgggatgtttgactactggggtcagggaaccctggtcaccgtctcgagc

SEQ ID NO: 601 - DNA, 369 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttactgatcagccgatggtgtgggtccgccaggctccagggaagggtctagagtgggtctcatcgattggggcgcgtggtgggcctacatactacgcagactccgtgaagggccggttcaccgtctcccgcgacaattccaagaacacgctgtatctgcaaatgaacagcctgcgtgccgaggacaccgcggtatattactgtgcgaaatggtttgatattattgcttgggatccttttagttttgactactggggtcagggaaccctggtcaccgtctcgagc

SEQ ID NO: 602 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaatcagtatcctatgatgtgggttcgccaggctccagggaagggtctagagtgggtctcaagtattactccttctggttttttgacatactacgcagactccgtgaagggccggttcaccatctcccgcgacaattccaagaacacgctgtatctgcaaatgaacagcctgcgtgccgaggacaccgcggtatattactgtgcggaatggaatccttttattactacgtttgactactggggtcagggaaccctggtgaccgtctcgagc

SEQ ID NO: 603 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgggcatcagcagatggcgtgggtccgccaggctccagggaagggtctagagtgggtctcaactattactccgaatggttattatacatactacgcagactccgtgaagggccggttcaccatctcccgcgacaattccaagaacacgctgtatctgcaaatgaacagcctgcgtgccgaggacaccgcggtatattactgtgcgaaatttgattattcgcttcgttttgactactggggtcagggaaccctggtcaccgtctcgagc

SEQ ID NO: 604 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgcttcttatgagatggcgtgggtccgccaggctccagggaagggtctagagtgggtctcatcgattggtagtgatggtgggccgacatactacgcagactccgtgaagggccggttcaccatctcccgcgacaattccaagaacacgctgtatctgcaaatgaacagcctgcgtgccgaggactccgcggtatattactgtgcgaaacctgatagggcttttgactactggggtcagggaaccctggtcaccgtctcgagc

SEQ ID NO: 605 - DNA, 372 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcaccttttctgcggagcagatgacttgggcccgccaggctccagggaagggtctagagtgggtctcaactattactccgcatggtgattctacatactacgcagactccgtgaagggccggttcaccatctcccgcgacaattccaagaacacgctgtatctgcaaatgaacagcctgcgtgccgaggacaccgcggtatattactgtgcgaaatggcggactttggttgattggcctacgagtgagtcgtttgactactggggtcagggaaccctggtcaccgtctcgagc

SEQ ID NO: 606 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttacgtcttatgagatggggtgggtccgccaggctccagggaagggtctagagtgggtctcatctattgagcctactggtattacgacatactacgcagactccgtgaagggccggttcaccatctcccgcgacaattccaagaacacgctgtatctgcaaatgaacagcctgcgtgccgaggacaccgcggtatattactgtgcgaaacctcattttactgagcttggttttgactactggggtcagggaaccctggtcaccgtctcgagc

SEQ ID NO: 607 - DNA, 351 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgagggggagcagatggcttgggtccgccaggctccagggaagggtctagagtgggtctcaacgattacgctgcctggtccgtatacattctacgcagactccgtgaagggccggttcaccatctcccgcgacaattccaagaacacgctgtatctgcaaatgaacagcctgcgtgccgaggacaccgcggtatattactgtgcgaaagggaatgggacgttttttgactactggggtcagggaaccctggtcaccgtctcgagc

SEQ ID NO: 608 - DNA, 360 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttggtaattatgcgatggcgtgggtccgccaggctccagggaagggtctagagtgggtctcaaagattggggcgcagggtcttcatacatactacgcaggctccgtgaagggccggttcaccatctcccgcgacaattccaagaacacgctgtatctgcaaatgaacagcctgcgtgccgaggacaccgcggtatattactgtgcgaaacagacgacgatggattatgagaggtttgactactggggtcagggaaccctggtcaccgtctcgagc

SEQ ID NO: 609 - DNA, 363 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgatgaggttgatatgtcgtgggtccgccaggctccagggaagggtctggagtgggtctcagctattggtaataatggtcttaagacatactacgcagactccgtgaagggccggttcaccatctcccgcgacaattccaagaacacgctgtatctgcaaatgaacagcctgcgtgccgaggacaccgcggtatattactgtgcgaaatcggctctgtcgtataggcctcctgtttttgactactggggtcagggaaccctggtcaccgtctcgagc

SEQ ID NO: 610 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcaggatgatactatgtcgtgggtccgccaggctccagggaagggtctagagtgggtctcaacgattacgcttaagggtccgtctacatactacgcagactccgtgaagggccggttcaccatctcccgcgacaattccaagaacacgctgtatctgcaaatgaacagcctgcgtgccgaggacaccgcggtatattactgtgcgaaatcgagggatgggttgtattttgactactggggtcagggaaccctggtcaccgtctcgagc

SEQ ID NO: 611 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgcttcgtctccgatggcttgggtccgccaggctccagggaagggtctagagtgggtctcaagtattggtcgggatggtagtacgacatactacgcagactccgtgaagggccggttcaccatctcccgcgacaattccaagaacacgctgtatctgcaaatgaacagcctgcgtgccgaggacaccgcggtatattactgtgcgaaaccttcgccttatcggcggtttgactactggggtcagggaaccctggtcaccgtctcgagc

SEQ ID NO: 612 - DNA, 360 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttactgattattcgatggtttgggtccgccaggctccagggaagggtctagagtgggtctcaactattgtgagtcatggtggtactacatactacgcagactccgtgaagggccgattcaccatctcccgcgacaattccaagaacacgctgtatctgcaaatgaacagcctgcgtgccgaggacaccgcggtatattactgtgcgaaaggtaagggttataatgcgcagtattttgactactggggtcagggaaccctggtcaccgtctcgagc

SEQ ID NO: 613 - DNA, 354 bp, Artificial Sequence; identical to SEQ ID NO: 603
  Description of Artificial Sequence: Synthetic polynucleotide

SEQ ID NO: 614 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaatgattatgatatgatttgggtccgccaggctccagggaagggtctagagtgggtctcaactattagttcgcatggtgatagtacatactacgcagactccgtgaagggccggttcaccatctcccgcgacaattccaagaacacgctgtatctgcaaatgaacagcctgcgtgccgaggacaccgcggtatattactgtgcgaaaggtgatgttttttttgactactggggtcagggaaccctggtcaccgtctcgagc

SEQ ID NO: 615 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgggcatcagcagatggcgtgggtccgccaggctccagggaagggtctagagtgggtctcaactattactccgaatggttattatacatactacgcagactccgtgaagggccggttcaccatctcccgcgacaattccaagaacacgctgtatctgcaaatgaacagcctgcgtgccgaggataccgcggtatattactgtgcggaatggtcggattcttttgactacaggggtcagggaaccctggtcaccgtctcgagc

SEQ ID NO: 616 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgctgattatgagatggcttgggtccgccaggctccagggaagggtctagagtgggtctcagggattcagtctaatggtaatattacatactacgcagactccgtgaagggccggttcaccatctcccgcgacaattccaagaacacgctgtatctgcaaatgaacagcctgcgtgccgaggacaccgcggtatattactgtgcgaaagctaattctcaggttgagtattttgactactggggtcagggaaccctggtcaccgtctcgagc

SEQ ID NO: 617 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttggggtggagcctatgtcttgggtccgccaggctccagggaagggtctagagtgggtctcaaatattggtcgtgatggttcgatgacatactacgcagactccgtgaagggccggttcaccatctcccgcgacaattccaagaacacgctgtatctgcaaatgaacagcctgcgtgccgaggacaccgcggtatattactgtgcgaaattggggaagcatggtacttttgactactggggtcagggaaccctggtcaccgtctcgagc

SEQ ID NO: 618 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttccggagtatcggatgatgtgggtccgccaggctccagggaagggtctggagtgggtctcatggattgatgagcggggttcgcttacatactacgcagactccgtgaagggccggttcaccatctcccgcgacaattccaagaacacgctgtatctgcaaatgaacagcctgcgtgccgaggacaccgcggtatattactgtgcgaaaaggcggaagggtactaagcagtttgactactggggtcagggaaccctggtcaccgtctcgagc

SEQ ID NO: 619 - DNA, 366 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgagttgtatgctatggcgtgggtccgccaggctccagggaagggtctagagtgggtctcaggtattggtgctgtgggtgagactacatactacgcagactccgtgaagggccggttcaccatctcccgcgacaattccaagaacacgctgtatctgcaaatgaacagcctgcgtgccgaggacaccgcggtatattactgtgcgaaagaggctaataatctttctgataatcttgtgtttgactactggggtcagggaaccctggtcaccgtctcgagc

SEQ ID NO: 620 - DNA, 351 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgggcatcagcagatggcgtgggtccgccaggctccagggaagggtctagagtgggtctcaactattactccgaatggttattatacatactacgcagactccgtgaagggccggttcaccatctcccgcgacaattccaagaacacgctgtatctgcaaatgaacagcctgcgtgccgaggacaccgcggtatattactgtgcgaaatggtcggttgagtggtttgactactggggtcagggaaccctggtcaccgtctcgagc

SEQ ID NO: 621 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaatagttatacgatgaattgggtccgccaggctccagggaagggtctagagtgggtctcaagtattaatccttggggtagtcggacatactacgcagactccgtgaagggccggttcaccatctcccgcgacaattccaagaacacgctgtatctgcaaatgaacagcctgcgtgccgaggataccgcggtatattactgtgcgaaaggtctggtgctgtttgactactggggtcagggaaccctggtcaccgtctcgagc

SEQ ID NO: 622 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgatggtgatatgatgtcttgggtccgccaggctccagggaagggtctagagtgggtctcatcgattactcagcttggtagtaggacatactacgcagactccgtgaagggccggttcaccatctcccgcgacaattccaagaacacgctgtatctgcaaatgaacagcctgcgtgccgaggacaccgcggtatattactgtgcgaaacagaattggcggactcttacttttgactactggggtcagggaaccctggtcaccgtctcgagc

SEQ ID NO: 623 - DNA, 357 bp, Artificial Sequence
  Description of Artificial Sequence: Synthetic polynucleotide
gaggtgcagctgttggagtctgggggaggcttggtacagcctggggggtccctgcgtctctcctgcgcagcctccggattcacctttaatgcttatgggatgatgtgggtccgccaggctccagggaagggtctagagtgggtctcatctattctttctgatggtgttattacatactacgcagactccgtgaagggccggttcaccatctcccgcgacaattccaagaacacgctgtatctgcaaatgaacagcctgcgtgccgaggacaccgcggtatattactgtgcgaaaagtgctcggggtgcgaatttttttgactactggggtcagggaaccctggtcaccgtctcgagc

SEQ ID NO: 624 - DNA, 360 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgggcattatatgatggtgtgggtccgccaggctccagggaagggtctggagtgggtctcatctattacgcctcatggtacgagtacatactacgcagactccgtgaagggccggttcaccatctcccgcgacaattccaagaacacgctgtatctgcaaatgaacagcctgcgtgccgaggacaccgcggtatattactgtgcggaatttaatgctatttttagtgaggcgtttgactactggggtcagggaaccctggtcaccgtctcgagc

SEQ ID NO: 625 - DNA, 360 bp, Artificial Sequence; identical to SEQ ID NO: 599
  Description of Artificial Sequence: Synthetic polynucleotide

SEQ ID NO: 626 - DNA, 360 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgatctttatgcgatggcttgggtccgccaggctccagggaagggtctagagtgggtctcaatgattgggagggatggtcgttttacatactacgcagactccgtgaagggccggttcaccatctcccgcgacaattccaagaacacgctgtatctgcaaatgaacagcctgcgtgccgaggacacggcggtatattactgtgcgaaattggctggttcgctgaggggtcgttttgactactggggtcagggaaccctggtcaccgtctcgagc

SEQ ID NO: 627 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaataaggctagtatgggttgggtccgccaggctccagggaagggtctagagtgggtctcaactattacgcctcatggttcgtctacatactacgcagactccgtgaagggccggttcaccatctcccgcgacaattccaagaacacgctgtatctgcaaatgaacagcctgcgtgccgaggacaccgcggtatattactgtgcgaaacagcggtggggtgttgagtttgactactggggtcagggaaccctggtcaccgtctcgagc

SEQ ID NO: 628 - DNA, 360 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcaggggtatagtatgggttgggtccgccaggctccagggaagggtctagagtgggtctcatctattgctgggcgtggtggtgttacatactacgcagactccgtgaagggccggttcaccatctcccgcgacaattccaagaacacgctgtatctgcaaatgaacagcctgcgtgccgaggacaccgcggtatattactgtgcgaaaggtttgtatatttatcatagtctgtttgactactggggtcagggaaccctggtcaccgtctcgagc

SEQ ID NO: 629 - DNA, 348 bp, Artificial Sequence
  Description of Artificial Sequence: Synthetic polynucleotide
gaggtgcagctgttggagtctgggggaggcttggtacagcctgggggctccctgcgtctctcctgtgcagcctccggattcacctttcctggtatggagatgtcgtgggtccgccaggctccagggaagggtctagagtgggtctcagctattactgggactggtagtacgacatactacgcagactccgtgaagggccggttcaccatctcccgcgacaattccaagaacacgctgtatctgcaaatgaacagcctgcgtgccgaggacaccgcggtatattactgtgcgaaaggttatcatccgtttgactactggggtcagggaaccctggtcaccgtctcgagc

SEQ ID NO: 630 - DNA, 351 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttccgatggtggctatgtcttgggtccgccaggctccagggaagggtctagagtgggtctcatctattgctcgggatggtaatgttacatactacgcagactccgtgaagggccggttcaccatctcccgcgacaattccaagaacacgctgtatctgcaaatgaacagcctgcgtgccgaggacgccgcggtatattactgtgcgaaagtttcgccgactggttttgactactggggtcagggaaccctggtcaccgtctcgagc

SEQ ID NO: 631 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgggcatcaggatatgtcgtgggtccgccaggctccagggaagggtctagagtgggtctcagggattacggatgatggtgagagtacatactacgcagactccgtgaagggccggttcaccatctcccgcgacaattccaagaacacgctgtatctgcaaatgaacagcctgcgtgccgaggacaccgcggtatattactgtgcgaaaggtgattatgattttgactactggggtcagggaaccctggtcaccgtctcgagc

SEQ ID NO: 632 - DNA, 351 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttggggagtataatatgatgtgggtccgccaggctccagggaagggtctagagtgggtctcacagattacgagggatggttctaggacatactacgcagactccgtgaggggccggttcaccatctcccgcgacaattccaggaacacgctgtatctgcaaatgaacagcctgcgtgccgaggactccgcggtatattactgtgcgaaactgtcgaatattgggtttgactactggggtcagggaaccctggtcaccgtctcgagc

SEQ ID NO: 633 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttagtgattattctatgatttgggcccgccaggctccagggaagggtctagagtgggtctcatcgattacgccgtatggttcttatacatactacgcagactccgtgaagggccggttcaccatctcccgcgacaattccaagaacacgctgtatctgcaaatgaacagcctgcgtgccgaggataccgcggtatattactgtgcgaaaactgattatttgtttgactactggggtcagggaaccctggtcaccgtctcgagc

SEQ ID NO: 634 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgatacgtatagtatgatgtgggtccgccaggctccagggaagggtcttgagtgggtctcaactattactccttatggtagttcgacatactacgcagactccgtgaagggccggttcaccatctcccgcgacaattccaagaacacgctgtatctgcaaatgaacagcctgcgtgccgaggataccgcggtatattactgtgcgaaatggggtctggtgtttgactactggggtcagggaaccctggtcaccgtctcgagc

SEQ ID NO: 635 - DNA, 354 bp, Artificial Sequence
  Description of Artificial Sequence: Synthetic polynucleotide
gaggtgcagctgttggagtctgggggaggcttggtacagcctggggggtccctgcgactctcctgtgcagcctccggattcacctttactacgggtcctatgatgtgggtccgccaggctccagggaagggtctagagtgggtctcagcgattggtattgggggtgatacgacatactacgcagactccgtgaagggccggttcaccatctcccgcgacaattccaagaacacgctgtatctgcaaatgaacagcctgcgtgccgaggacaccgcggtctattactgtgcgaaattgactccgtctaatcagtttgactactggggtcagggaaccctggtcaccgtctcgagc

SEQ ID NO: 636 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaagcagtatcagatgatgtgggttcgccaggctccagggaagggtctagagtgggtctcaagtattactccttctggttttttgacatactacgcagactccgtgaagggccggttcaccatctcccgcgacaattccaagaacacgctgtatctgcaaatgaacagcctgcgtgccgaggacaccgcggtatattactgtgcggaatggaatccttttattagtacgtttgactactggggtcagggaaccctggtcaccgtctcgagc

SEQ ID NO: 637 - DNA, 360 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcctaattatgatatggtttgggtccgccaggctccagggaagggtctagagtgggtctcatcgatttctgctttgggtaatgttacatactacgcagactccgtgaagggccggttcaccatctcccgcgacaattccaagaacacgctgtatctgcaaacgaacagcctgcgtgccgaggacactgcggtatattactgtgcgaaatggcgtagtgctattactggtaattttgactactggggtcagggaaccctggtcaccgtctcgagc

SEQ ID NO: 638 - DNA, 369 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaaggagtatcagatgtcttgggtccgccaggctccagggaagggtctagagtgggtctcaactatttcgccgtcgggtatgaatacatactacgcagactccgtgaagggccggttcaccatctcccgcgacaattccaagaacacgctgtatctgcaaatgaacagcctgcgtgccgaggacaccgcggtatattactgtgcggaatggcggtcggttgttcgtccttggccgggtgtgtttgactactggggtcagggaaccctggtcaccgtctcgagc

SEQ ID NO: 639 - DNA, 363 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgatgatgagagtatggcgtgggtccgccaggctccagggaagggtctagagtgggtctcatcgattactcctcatggtacttttacatactacgcagactccgtgaagggccggttcaccatctcccgcgacaattccaagaacacgctgtatctgcaaatgaacagcctgcgtgccgaggacaccgcggtatattactgtgcgaaacttcatcttaagttgtatgagtctcattttgactactggggtcagggaaccctggtcaccgtctcgagc

SEQ ID NO: 640 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgagggtggtgagatgggttgggtccgccaggctccagggaagggtctagagtgggtctcaatgattccgatggatggtagtgcgacatactacgcagactccgtgaagggccggttcaccatctcccgcgacaattccaagaacacgctgtatctgcaaatgaacagcctgcgtgccgaggacaccgcggtatattactgtgcgaaagcggggagtacgtttgactactggggtcagggaaccctggtcaccgtctcgagc

SEQ ID NO: 641 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgattttatgccgatggcgtgggtccgccaggctccagggaagggtctagagtgggtctcatctattgggagggatggtgcttatacatactacgcagactccgtgaagggccggttcaccatctcccgcgacaattccaagaacacgctgtatctgcaaatgaacagcctgcgtgccgaggacaccgcggtatattactgtgcgaaacttgcttcgccggcgcagtttgactactggggtcagggaaccctggtcaccgtctcgagc

SEQ ID NO: 642 - DNA, 363 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttggtgatgagcctatgctgtgggtccgccaggctccagggaagggtctagagtgggtctcatctattgggggtacgggtacgacgacatactacgcagactccgtgaagggccggttcaccatctcccgcgacaattccaagaacacgctgtatctgcaaatgaacagcctgcgtgccgaggacaccgcggtatattactgtgcgaaaggtaatcagggtgattttattaatcggtttcactactggggtcagggaaccctggtcaccgtctcgagc

SEQ ID NO: 643 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcatgcgtataatatggcgtgggtccgccaggctccagggaagggtctagagtgggtctcaacgatttctccgcggggttcttatacatactacgcagactccgtgaagggccggttcaccatctcccgcgacaattccaagaacacgctgtatctgcaaatgaacagcctgcgtgccgaggacaccgcggtatattactgtgcgaaatggccgccgccttcgtctcattttgactactggggtcagggaaccctggtcaccgtctcgagc

SEQ ID NO: 644 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgatgggtatgagatggcgtgggtccgccaggctccagggaagggtctagagtgggtctcatctattacgagtgatggtacgagtacatactacgcagactccgtgaagggccggttcaccatctcccgcgacaattccaagaacacgctgtatctgcaaatgaacagcctgcgtgccgaggacaccgcggtatattactgtgcgaaaccggggctgcgttttgactactggggtcagggaaccctggtcaccgtctcgagc

SEQ ID NO: 645 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgagggttatatgatgtattgggtccaccaggctccggggaagggtctagagtgggtctcatctatttctcctcagggtcattttacatactacgcagactccgtgaagggccggttcaccatctcccgcgacaattccaagaacacgctgtatctgcaaatgaacagcctgcgtgccgaggacaccgcggtatattactgtgcggaacttcgtgagcttcctcgtctgtttgactactggggtcagggaaccctggtcaccgtctcgagc

SEQ ID NO: 646 - DNA, 369 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttagtagttatgctatgggttgggtccgccaggctccagggaagggtctagagtgggtctcatcgattgatgcgagtggtggtcctacatactacgcagactccgtgaagggccggttcaccatctcccgcgacaattccaagaacacgctgtatctgcaaatgaacagcctgcgtgccgaggacaccgcggtatattactgtgcgaaagcgaatgggaagaagtttccttttactaagtattttgactactggggtcagggaaccctggtcaccgtctcgagc

SEQ ID NO: 647 - DNA, 369 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcctagtgtgcatatggcgtgggtccgccaggctccagggaagggtctagagtgggtctcagggattaatctgacgggtgttgatacatactacgcagactccgtgaagggccggttcaccatctcccgcgacaattccaagaacacgctgtatctgcaaatgaacagcctgcgtgccgaggacaccgcggtatattactgtgcgaaaagtgctactactaggcaggcgcatccgttgtattttgactactggggtcagggaaccctggtcaccgtctcgagc

SEQ ID NO: 648 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaaggagggtgagatgtattgggtccgccaggctccagggaagggtctagagtgggtctcaacgatttcgactaatggtcttactacatactacgcagactccgtgaagggccggttcaccatctcccgcgacaattccaagaacacgctgtatctgcaaatgaacagcctgcgtgccgaggacaccgcggtatattactgtgcgaaatctactcgtgatctgggttttgcctactggggtcagggaaccctggtcaccgtctcgagc

SEQ ID NO: 649 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgaggagtatgagatggcttgggcccgccaggctccagggaagggtctagagtgggtctcatttatttctcctcgtggtcattttacatactacgcagactccgtgaagggccggttcaccatctcccgcgacaattccaagaacacgctgtatctgcaaatgaacagcctgcgtgccgaggacaccgcggtatattactgtgcgaaaccggctaagacttttgactactggggtcagggaaccctggtcaccgtctcgagc

SEQ ID NO: 650 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgatacgtatgagatgctttgggtccgccaggctccagggaagggtctagagtgggtctcacgtatttctgttgatggtagtattacatactacgcagactccgtgaagggccggttcaccatctcccgcgacaattccaagaacacgctgtatctgcaaatgaacagcctgcgtgccgaggataccgcggtatattactgtgcgaaaacgcggatgcgttttgactactggggtcagggaaccctggtcaccgtctcgagc

SEQ ID NO: 651 - DNA, 372 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttagttcgtatgctatgtcgtgggtccgccaggctccagggaagggtctagagtgggtctcaaatatttctcgtgatggttcgaagacatactacgcagactccgtgaagggccggttcaccatctcccgcgacaattccaagaacacgctgtatctgcaaatgaacagcctgcgtgccgaggacaccgcggtatattactgtgcggaagcgcagtctggggggcttcggtcgggtttgactacgtttgactactggggtcagggaaccctggtcaccgtctcgagc

SEQ ID NO: 652 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagactccggattcacctttagcagctatgccatgagctgggtccgccaggctccagggaagggtctagagtgggtctcatctattgggagggatggtgcttatacatactacgcagactccgtgaagggccggttcaccatctcccgcgacaattccaagaacacgctgtatctgcaaatgaacagcctgcgtgccgaggacaccgcggtatattactgtgcgaaagcggggccgaagggtattgcgtttgactactggggtcagggaaccctggtcaccgtctcgagc

SEQ ID NO: 653 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttagtccgcatgctatggcttgggtccgccaggctccagggaagggtctggagtgggtctcaggtattgatggggggggttcgatgacatactacgcagactccgtgaagggccggttcaccatctcccgcgacaattccaagaacacgctgtatctgcaaatgaacagcctgcgtgccgaggacaccgcggtatattactgtgcgaaatcggatcctccgtttgactactggggtcagggaaccctggtcaccgtctcgagc

SEQ ID NO: 654 - DNA, 354 bp, Artificial Sequence
  Description of Artificial Sequence: Synthetic polynucleotide
gaggtgcagctgttggagtctgggggaggcttggtacagcctggggggtccctgcgtctctcctgcgcagcctccggattcacctttcatgcgggggagatgcattgggtccgccaggctccagggaagggtctagagtgggtctcatcgattacgctgcctggtgatatgacatactacgcagactccgtgaagggccggttcaccatctcccgcgacaattccaagaacacgctgtatctgcaaatgaacagcctgcgtgccgaggacaccgcggtatattactgtgcgaaaccgaatactgggtatacttttgactactggggtcagggaaccctggtcaccgtctcgagc

SEQ ID NO: 655 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgggaattatggtatgtcgtgggtccgccaggctccagggaagggtctagagtgggtctcaagtatttcgtgggatggttctcttacatactacgcagactccgtgaagggccggttcaccatctcccgcgacaattccaagaacacgctgtatctgcaaatgaacagcctgcgtgccgaggacaccgcggtatattactgtgcgcaaaatacgcggctttttgactactggggtcagggaaccctggtcaccgtctcgagc

SEQ ID NO: 656 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcatgatgcggatatgctgtgggtccgccaggctccagggaagggtctagagtgggtctcaggtattttgtctccgggtgaggatacatactacgcagactccgtgaagggccggttcaccatctcccgcgacaattccaagaacacgctgtatctgcaaatgaacagcctgcgtgccgaggacaccgcggtatattactgtgcgaaatttggtctgccgtttgactactggggtcagggaaccctggtcaccgtctcgagc

SEQ ID NO: 657 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgtactgatcagatgaattgggtccgccaggctccagggaagggtctagagtgggtctcaagtatttctcctagtggtgcgtatacatactacgcagactccgtgaagggccggttcaccatctcccgcgacaattccaagaacacgctgtatctgcaaatgaacagcctgcgtgccgaggataccgcggtatattactgtgcgaaaggtcttggtgcttttgactactggggtcagggaaccctggtcaccgtctcgagc

SEQ ID NO: 658 - DNA, 360 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcatctttgagcagtatcagatggtttgggtccgccaggctccagggaagggtctagagtgggtctcatggatttcgcctgatggtacgcatacatactacgcagactccgtgaagggccggttcaccatctcccgcgacaattccaagaacacgctgtatctgcaaatgaacagcctgcgtgccgaggacaccgcggtatattactgtgcgaaatttagtttgcgtaagatggagaagtttgactactggggtcagggaaccctggtcaccgtctcgagc

SEQ ID NO: 659 - DNA, 348 bp, Artificial Sequence
  Description of Artificial Sequence: Synthetic polynucleotide
gaggtgcagctgttggaatctgggggaggcttggtacagcctggggggtccctgcgtctctcctgtgcagcctccggattcacctttcaggatgagcagatggcgtgggtccgccaggctccagggaagggtctagagtgggtctcaagtattgcgtctgatggtatgtctacatactacgcagactccgtgaagggccggttcaccatctcccgcgacaattccaagaacacgctgtatctgcaaatgaatagcctgcgtgccgaggacaccgcggtatattactgtgcgcaacctgggaagaattttgaccactggggtcagggaaccctggtcaccgtctcgagc

SEQ ID NO: 660 - DNA, 360 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttagtgattatgcgatgagttgggtccgccaggctccagggaagggtctagagtgggtctcatcgattactactgggggtgagcggacatactacgcagactccgtgaagggccggttcaccatctcccgcgacaattccaagaacacgctgtatctgcaaatgaacagcctgcgtgccgaggacaccgcggtatattactgtgcgaaacgttggaatctgtatacggagtcttttgactactggggtcagggaaccctggtcaccgtctcgagc

SEQ ID NO: 661 - DNA, 351 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttggtggtcagccgatggattgggtccgccaggctccagggaagggtctagagtgggtctcatctattgctcctgatggtattcatacatactacgcagactccgtgaagggccggttcaccatctcccgcgacaattccaagaacacgctgtatctgcaaatgaacagcctgcgtgccgaggacaccgcggtatattactgtgcgaaaaatttgggtcagggttttgactactggggtcagggaaccctggtcaccgtctcgagc

SEQ ID NO: 662 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgagcggtatcagatgacgtgggtccgccaggctccagggaagggtctagagtgggtctcaagtatttctcctagtggtacgtttacatactacgcagactccgtgaagggccggttcaccatctcccgcgacaattccaagaacacgctgtatctgcaaatgaacagcctgcgtgccgaggacaccgcggtatattactgtgcggaatggaaggcgctttttgactactggggtcagggaaccctggtcaccgtctcgagc

SEQ ID NO: 663 - DNA, 351 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcctcattcgactatgtattgggtccgccaggctccagggaagggtctagagtgggtctcacttattttgccgtcgggtagtcgtacatactacgcagactccgtgaagggccggttcaccatctcccgcgacaattccaagaacacgctgtatctgcaaatgaacagcctgcgtgccgaggacaccgcggtatattactgtgcgaaattttctgatgagcgttttgactactggggtcagggaaccctggtcaccgtctcgagc

SEQ ID NO: 664 - DNA, 351 bp, Artificial Sequence
  Description of Artificial Sequence: Synthetic polynucleotide
gaggtgcagctgtcggagtctgggggaggcttggtacagcctggggggtccctgcgtctctcctgtgcagcctccggattcacctttggtgatgggaatatggattgggtccgccaggctccagggaagggtctagagtgggtctcaggtatttctagtgatggtgtgacgacatactacgcagactccgtgaagggccggttcaccatctcccgcgacaattccaagaacacgctgtatctgcaaatgaacagcctgcgtgccgaggacaccgcggtatattactgtgcgaaagataggggtcaggggtttgactactggggtcagggaaccctggtcaccgtctcgagc

SEQ ID NO: 665 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcttccggattcacctttgatgattatatgatgtggtgggtccgccaggctccagggaagggtctagagtgggtctcatctattagtccgcatggtgtttatacatactacgcagactccgtgaagggccggttcaccatctcccgcgacaattccaagaacacgctgtatctgcaaatgaacagcctgcgtgccgaggataccgcggtatattactgtgcgaaatggttgcatacgtttgactactggggtcagggaaccctggtcaccgtctcgagc

SEQ ID NO: 666 - DNA, 369 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcaccttttcgaattatacgatggcgtggggccgccaggctccagggaagggtctagagtgggtctcatttattgctggtccgggtaattatacatactacgcagactccgtgaagggccggttcaccatctcccgcgacaattccaagaacacgctgtatctgcaaatgaacagcctgcgtgccgaggacaccgcggtatattactgtgcgaaaccggggagtactgcgacgtataataatggtcagtttgactactggggtcagggaaccctggtcaccgtctcgagc

SEQ ID NO: 667 - DNA, 366 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttacggagtatagtatggtgtgggtccgccaggctccagggaagggtctggagtgggtctcatctattagtgggagtggtcgtgttacatactacgcagactccgtgaagggccggttcaccatctcccgcgacaattccaagaacacgctgtatctgcaaatgaacagcctgcgtgccgaggacaccgcggtatattactgtgcgaaatggcttaagctggttagggctcctaatccgtttgactactggggtcagggaaccctggtcaccgtctcgagc

SEQ ID NO: 668 - DNA, 360 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttagtaattatcagatggcgtgggtccgccaggctccagggaagggtctagagtgggtctcaggtatttctaagactggtcattctacatactacgcagactccgtgaagggccggttcaccatctcccgcgacaattccaggaacacgctgtatctgcaaatgaacagcctgcgtgccgaggacaccgcggtatattactgtgcgaaagcttcgcattcgttggggcctctttttgactactggggtcagggaaccctggtcaccgtctcgagc

SEQ ID NO: 669 - DNA, 369 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttacggcgtataggatggcttgggtccgccaggctccagggaagggtctagagtgggtctcatggatttcgccttctggttcggggacatactacgcagactccgtgaagggccggttcaccatctcccgcgacaattccaagaacacgctgtatctgcaaatgaacagcctgcgtgccgaggacaccgcggtatattactgtgcgaaaactttgacggattcgccgtcggggcattatgagtttgactactggggtcagggaaccctggtcaccgtctcgagc

SEQ ID NO: 670 - DNA, 369 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgcgcggtatgagatggggtgggtccgccaggctccagggaagggtctagagtgggtctcacggattactgctcagggtcttgggacatactacgcagactccgtgaagggccggttcaccatctcccgcgacaactccaagaacacgctgtatctgcaaatgaacagcctgcgtgccgaggataccgcggtatattactgtgcgaaatatcttactgattttagtagtgggcatcaggagtttgactactggggtcagggaaccctggtcaccgtctcgagc

SEQ ID NO: 671 - DNA, 366 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgatgattatggtatgtcgtgggtccgccaggttccagggaagggtctggagtgggtctcaggtattagtcataatggtatgttgacatactacgcagactccgtgaagggccggttcaccatctcccgcgacaattccaagaacacgctgtatctgcaaatgaacagcctgcgtgccgaggataccgcggtatattactgtgcgaaatattggccgtctactagttgggagactgattttgactactggggtcagggaaccctggtcaccgtctcgagc

SEQ ID NO: 672 - DNA, 351 bp, Artificial Sequence
  Description of Artificial Sequence: Synthetic polynucleotide
gaggtgcagctgttggagtctgggggaggctcggtacagcctggggggtccctgcgtctctcctgtgcagcctccggattcacctttgggaatgagcctatggcttgggtccgccaggctccagggaagggtctagagtgggtctcaagtattgagatgcagggtaagaatacatactacgcagactccgtgaagggccggttcaccatctcccgcgacaattccaagaacacgctgtatctgcaaatgaacagcctgcgtgccgaggacaccgcggtatattactgtgcgaaagataggggtcaggggtttgactactggggtcagggaaccctggtcaccgtctcgagc

SEQ ID NO: 673 - DNA, 360 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttggggaggaggagatgagttgggtccgccaggctccagggaagggtctagagtgggtctcatgtattgataatctgggtagtcctacatactacgcagactccgtgaagggccggttcaccatctcccgcgacaattccaagaacacgctgtatctgcaaatgaacagcctgcgtgccgaggacgccgcggtatattactgtgcgaaaacgatttctcatcagtatgataggtttgactactggggtcagggaaccctggtcaccgtctcgagc

SEQ ID NO: 674 - DNA, 360 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttggggaggaggagatgagttgggtccgccaggctccagggaagggtctagagtgggtctcatcgattgatgaggggggtcggtggacatactacgcagactccgtgaagggccggttcaccatctcccgcgacaattccaagaacacgctgtatctgcaaatgaacagcctgcgtgccgaggacaccgcggtatattactgtgcgaaatggacgccgcataagcagttgtcgtttgactactggggtcagggaaccctggtcaccgtctcgagc

SEQ ID NO: 675 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcagctttgctgatgagtatatggtttgggcccgccaggctccagggaagggtctagagtgggtctcagagattgatccgttgggtactgggacatactacgcagactccgtgaagggccggttcaccatctcccgcgacaattccaagaacacgctgtatctgcaaatgaacagcctgcgtgccgaggacaccgcggtatattactgtgcgaaatatgggacggcttttgactactggggtcagggaaccctggtcaccgtctcgagc

SEQ ID NO: 676 - DNA, 357 bp, Artificial Sequence
  Description of Artificial Sequence: Synthetic polynucleotide
gaggtgcagctgttggagtctgggggaggcttggtacagcctggggggtccctgcgcctctcctgtgcagcctccggattcaccttttctacgcatgatatgatgtgggtccgccaggctccagggaagggtctagagtgggtctcatcgatttctgatgatggtattagtacatactacgcagactccgtgaagggccggttcaccatttcccgcgacaattccaagaacacgctgtatctgcaaatgaacagcctgcgtgccgaggataccgcggtatattactgtgcgaaacctgatatgtctcttattgagtttgactactggggtcagggaaccctggtcaccgtctcgagc

SEQ ID NO: 677 - DNA, 363 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgatggtactccgatggtttgggtccgccaggctccagggaagggtctagagtgggtctcagggattagtggtgatggtaggaatacatactacgcagactccgtgaagggccggttcaccatctcccgcgacaattccaagaacacgctgtatctgcaaatgaacagcctgcgtgccgaggacaccgcggtatattactgtgcggaaccttatgcgcttacttcgtctaagccttttgactactggggtcagggaaccctggtcaccgtctcgagc

SEQ ID NO: 678 - DNA, 369 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaatgattatactatgggttgggtccgccaggctccagggaagggtctagagtgggtctcatggattcatgggactggtggtcagacatactacgcagactccgtgaagggccggttcaccatctcccgcgacaattccaagaacacgctgtatctgcaaatgaacagcctgcgtgccgaggacaccgcggtatattactgtgcgaaagctttggctgataggagtgggggggttgttgagtttgactactggggtcagggaaccctggtcaccgtctcgagc

SEQ ID NO: 679 - DNA, 360 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgaggcggagacgatggcttgggtccgccaggctccagggaagggtctagagtgggtctcatgtattagtaatgatggtaatacgacatactacgcagactccgtgaagggccggttcaccatctcccgcgacaattccaagaacacgctgtatctgcaaatgaacagcctgcgtgccgaggacaccgcggtatattactgtgcgaaagagtctctgattagtcctggtctttttgactactggggtcagggaaccctggtcaccgtctcgagc

SEQ ID NO: 680 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttactggtgagtatatgaattgggtccgccaggctccagggaagggtctagagtgggtctcaactattaatgagactggttatatgacatactacgcagactccgtgaagggccggttcaccatctcccgcgacaattccaagaacacgctgtatctgcaaatgaatagcctgcgtgccgaggacaccgcggtatattactgtgcgaaactttctacgaggggggtgccttttgactactggggtcagggaaccctggtcaccgtctcgagc

SEQ ID NO: 681 - DNA, 360 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaggtcgtatgatatgggttgggtccgccaggctccagggaagggtctagagtgggtctcaacgatttcgcctatgggtgtttttacatactacgcagactccgtgaagggccggttcaccatctcccgcgacaattccaagaacacgctgtatctgcaaatgaacagcctgcgtgccgaggacaccgcggtatattactgtgcgaaatctaatcagcatgctcatgatccttttgactactggggtcagggaaccctggtcaccgtctcgagc

SEQ ID NO: 682 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttagtgattatgatatgggttgggtccgccaggctccagggaagggtctggagtgggtctcaagtatttcgcctatgggtacgtttacatactacgcagactccgtgaagggccggttcaccatctcccgcgacaattccaagaacacgctgtatctgcaaatgaacagcctgcgtgccgaggacaccgcggtatattactgtgcgaaagctgctttgactgagcctatgtttgactactggggtcagggaaccctggtcaccgtctcgagc

SEQ ID NO: 683 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgtgattatgatatgggttgggtccgccaggctccagggaagggtctagagtgggtctcaactatttctcctcttggtcattttacatactacgcagactccgtgaagggccggtccaccatctcccgcgacaattccaagaacacgctgtatctgcaaatgaacagcctgcgtgccgaggataccgcggtatattactgtgcgaaagctgaggaggcttttgactactggggtcagggaaccctggtcaccgtctcgagc

SEQ ID NO: 684 - DNA, 348 bp, Artificial Sequence
  Description of Artificial Sequence: Synthetic polynucleotide
gaggtgcagctgttggagtctgggggaggcttggtacagcctggggggtccctgcgcctctcctgtgcagcctccggattcgcctttcctaggtatggtatgacgtgggtccgccaggctccagggaagggtctagagtgggtctcaaatattgatcagtttggtatgaagacatactacgcagactccgtgaagggccggttcaccatctcccgcgacaattccaagaacacgctgtatctgcaaatgaacagcctgcgtgccgaggacaccgcggtatattactgtgcggaagagtatgcttcgtttgactactggggtcagggaaccctggtcaccgtctcgagc

SEQ ID NO: 685 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgataagtatgatatgggttgggtccgccaggctccagggaagggtctagagtgggtctcaacgatttcgcctatgggtgtttttacatactacgcagactccgtgaagggccggttcaccatctcccgcgacaattccaagaacacgctgtatctgcaaatgaacagcctgcgtgccgaggacaccgcggtatattactgtgcgaaagggcggggtaatacttcggattttgactactggggtcagggaaccctggtcaccgtctcgagc

SEQ ID NO: 686 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttagtaattatgatatggcgtgggtccgccaggctccagggaagggtctagagtgggtctcaactatttctggggcgggtcattttacatactacgcagactccgtgaagggccggttcaccatctcccgcgacaattccaagaacacgctgtatctgcaaatgaacagcctgcgtgccgaggacaccgcggtatattactgtgcgaaaagttttccgcgtgatgagtttgactactggggtcagggaaccctggtcaccgtctcgagc

SEQ ID NO: 687 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttccgaagtatgagatgaggtgggtccgccaggctccagggaagggtctagagtgggtctcagagattggtctggatggttcgcctacatactacgcagactccgtgaagggccggttcaccatctcccgcgacaattccaagaacacgctgtatctgcaaatgaacagcctgcgtgccgaggacaccgcggtatattactgtgcgaaattgggggatccgaatggttttgactactggggtcagggaaccctggtcaccgtctcgagc

SEQ ID NO: 688 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttccgactagtgagatggattgggtccgccaggctccagggaagggtctggagtgggtctcaggtattgggcctgatggtttgactacatactacgcagactccgtgaagggccggttcaccatctcccgcgacaattccaagaacacgctgtatctgcaaatgaacagcctgcgtgccgaggacaccgcggtatattactgtgcgaaacatgcggattggtttgactactggggtcagggaaccctggtcaccgtctcgagc

SEQ ID NO: 689 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcaccttttctgagtatgatatgtattgggtccgccaggctccagggaagggtctagagtgggtctcatggattgatactgatggtggggatacatactacgcagactccgtgaagggccggttcaccatctcccgcgacaattccaagaacacgctgtatctgcaaatgaacagcctgcgtgccgaggacaccgcggtatattactgtgcgaaacctggtctgaagtttgactactggggtcagggaaccctggtcaccgtctcgagc

SEQ ID NO: 690 - DNA, 351 bp, Artificial Sequence
  Description of Artificial Sequence: Synthetic polynucleotide
gaggtgcagctgttggagtctgggggaggcctggtacagcctggggggtccctgcgtctctcctgtacagcctccggattcacctttgagaatgcttctatgcagtgggtccgccaggctccagggaagggtctagagtgggtctcatctattgaggggcagggtaatgctacatactacgcagactccgtgaagggccggttcaccatctcccgcgacaattccaagaacacgctgtatctgcaaatgaacagcctgcgtgccgaggacaccgcggtatattactgtgcgaaaagttcgtcttggtcttttgactactggggtcagggaaccctggtcaccgtctcgagc

SEQ ID NO: 691 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttacgcgtaatgagatggggtgggtccgccaggctccagggaagggtctagagtgggtctcaactattacgccgactggtacgtttacatactacgcagactccgtgaagggccggttcaccatctcccgcgacaattccaagaacacgctgtatctgcaaatgaacagcctgcgtgccgaggacaccgcggtatattactgtgcgaaaacggatcctggtaataggtattttgactactggggtcagggaaccctggtcaccgtctcgagc

SEQ ID NO: 692 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaattggcagctgatgggttgggtccgccaggctccagggaagggtctagagtgggtctcaggtattgagggtcctggtgatgttacatactacgcagactccgtgaagggccggttcaccatctcccgcgacaattccaagaacacgctgtatctgcaaatgaacagcctgcgtgccgaggacaccgcggtatattactgtgcgaaagttgggaaggagagtaattttgactaccggggtcagggaaccctggtcaccgtctcgagc

SEQ ID NO: 693 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaattggcagctgatgggttggttccgccaggctccagggaagggtctagagtgggtctcaggtattgagggtcctggtgatgttacatactacgcagactccgtgaagggccggttcaccatctcccgcgacaattccaagaacacgctgtatctgcaaatgaacagcctgcgtgccgaggacaccgcggtatattactgtgcgaaagttgggaaggagagtaattttgactaccggggtcaggggaccctggtcaccgtctcgagc

SEQ ID NO: 694 - DNA, 354 bp, Artificial Sequence
  Description of Artificial Sequence: Synthetic polynucleotide
gaggtgcagctgttggagtctggtggaggcttggtacagcctggggggtccctgcgtctctcctgtgcagcctccggattcacctttaattggcagctgatgggttgggtccgccaggctccagggaagggtctagagtgggtctcaggtattgagggtcctggtgatgttacatactacgcagactccgtgaagggccggttcaccgtctcccgcgacaattccaagaacacgctgtatctgcaaatgaacagcctgcgtgccgaggacaccgcggtatattactgtgcgaaagttgggaaggagagtaattctgactaccggggtcagggaaccctggtcaccgtctcgagc

SEQ ID NO: 695 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctcaggattcacctttaattggcagctgatgggttgggtccgccaggctccagggaagggtctagagtgggtctcaggtattgagggtcctggtgatgttacatactacgcagattccgtgaagggccggttcaccatctcccgcgacaattccaagaacacgctgtatctgcaaatgaacagcctgcgtgccgaggacaccgcggtatattactgtgtgaaagttgggaaggagagtaattctgactaccggggtcagggaacccaggtcaccgtctcgagc

SEQ ID NO: 696 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaattggcagctgatgggttgggcccgccaggctccagggaagggtctagagtgggtctcaggtattgagggtcctggtgatgttacatactacgcagactccgtgaagggccggttcaccatctcccgcgacaattccaagaacacgctgtatctgcaaatgaacagcctgcgtgccgaggacaccgcggtatattactgtgcgaaagttgggaaggagagtaattctgactaccggggtcagggaaccctggtcaccgtctcgagc

SEQ ID NO: 697 - DNA, 354 bp, Artificial Sequence
  Description of Artificial Sequence: Synthetic polynucleotide
gaggtgcagttgttggagtctgggggaggcttggtacagcctggggggtccctgcgtctctcctgtgcagcctccggattcacctttaattggcagctgatgggttgggcccgccaggctccagggaagggtctagagtgggtctcaggtattgagggtcctggtgatgttacatactacgcagactccgtgaaggaccggttcaccatctcccgcgacaattccaagaacacgctgtatctgctaatgaacagcctgcgtgccgaggacaccgcggtatattactgtgcgaaagtagggaaggagagtaattttgactactggggtcagggaaccctggtcaccgtctcgagc

SEQ ID NO: 698 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaattggcagctgatgggttgggtccgccaggctccagggaagggtctagagtgggtctcaggcattgagggtcctggtgatgttacatactacgcagactcagtgaagggccggttcaccatctcccgcgacaataccaagaacacgctgtatctgcaaatgaacagcctgcgtgccgaggacaccgcggtatattactgtgtgaaagttgggaaggagagtaattctgactaccggggtcagggaaccctggtcaccgtctcgagc

SEQ ID NO: 699 - DNA, 354 bp, Artificial Sequence
  Description of Artificial Sequence: Synthetic polynucleotide
gaggtgcggctattggagtctgggggaggcttggtacagcctggggggtccctgcgtctctcctgtgcagcctccggattcaactttaattggcagctgatgggttggatccgccaggctccagggaagggtctagagtgggtctcaggtattgagggtcctggtgatgttacatactacgcagactccgtgaagggccggttcaccatctcccgcgacaattccaagaacacgctgtatctgcaaatgaacagcctgcgtgccgaggacaccgcagtatattactgtgcgaaagttgggaaggagagtaattctgactaccggggtcagggaaccctggtcaccgtctcgagc

SEQ ID NO: 700 - DNA, 354 bp, Artificial Sequence
  Description of Artificial Sequence: Synthetic polynucleotide
gaggtgcagctgttggagtctgggggaggcttggtacggcctggggggtcactgcgtctctcctgtgtagcctccggattcacctttaattggcagctgatgggttgggtccgccaggctccagggaagggtctagagtgggtctcaggtattgagggtcctggtgatgttacatactacgcagactccgtgaagggccggttcaccatctcccgcgacaattccaagaacacgctgtatctgcaaatgaacagcctgcgtgccgaggacaccgcggtatattactgtgcgaaagttgggaaggagagtaattttgactaccggggtcagggaaccctggtcaccgtctcgagc

SEQ ID NO: 701 - DNA, 354 bp, Artificial Sequence
  Description of Artificial Sequence: Synthetic polynucleotide
gaggtgcagctgttggagtctgggggaggcttggtacagactggggggtccctgcgtctctcctgtgcagcctccggattcacctataattggcagctgatgggttgggtccgccaggctccagggaagggtctagagtgggtctcaggtattgagggtcctggtgatgttacatactacgcagactccgtgaagggccggttcaccatctcccgcgacaattccaagaacacgctgtatctgcaaatgaacagcctgcgtgccgatgacaccgcggtatattactgtgtgaaagttgggaaggagagtaattttgactaccggggtcacggaaccctggtcaccgtctcgagc

SEQ ID NO: 702 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaattggcagctgatgggttgggtccgcaaggctcctgggaagggtctagagtgggtctcaggtattgagggtcctggtgatgttacatactacgcagactccgtgaagggccggttcaccatctcccgcgacaattccaagaacacgctgtatctgcaaatgaacagcctgcgtgccgaggacaccgcggtatattactgtgcgaaagttgggaaggagagtaattttgactaccggggtcagggaaccctggtcaccgtctcgagc

SEQ ID NO: 703 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaattggcagctgatgggttgggtccgccaggccccagggaagggtctagagtgggtctcaggtattgagggtcctggtgatgttacatactacgcagactccgtgaagggccggttcaccatctcccgcgacaataccaagaacacgctgtatctgcaaatgaacagcctgcgtgccgaggacaccgcggtatattactgtgcgaaagttgggaaggagagtaattttgactaccggggtcagggaaccctggtcaccgtctcgagc

SEQ ID NO: 704 - DNA, 354 bp, Artificial Sequence
  Description of Artificial Sequence: Synthetic polynucleotide
gaggtgcagctgttggagtctgggggaggcttggtacagcctggggggtccctgcgcctctcctgtgcagcctccggattcacctttaattggcagctgatgggttgggtccgccaggctccagggaagggtcttgagtgggtctcaggtattgagggtcctggtgatgttacatactacgcagactccgtgaagggccggttcaccatctcccgcgacaattccaagaacacgctgtatctgcaaatgaacagcctgcgtgccgaggacaccgcggtatattactgtgcgaaagttgggaaggagagtaagtttgactacctgggtcagggaaccctggtcaccgtctcgagc

SEQ ID NO: 705 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaattggcagctgatgggttgggtccgccaggctccagggaagggtctagagtgggtctcaggtattgagggtcctggtgatgttacatactacgcagaatccgtgaagggccggttcaccatctcccgcgacaattccaagaacacgctgtatctgcaaatgaacagcctgcgtgccgaggacaccgcggtatattactgtgcgaaagttgggaaggagagtaatcttgactaccggggtcagggaaccctggtcaccgtctcgagc

SEQ ID NO: 706 - DNA, 354 bp, Artificial Sequence
  Description of Artificial Sequence: Synthetic polynucleotide
gaggtgcagctgtttgagtctgggggaggctcggtacagcctggggggtccctgcgtctctcctgtgcagcctccggattcacctttaattggcagctgatgggttgggtccgccaggctccagggaagggtctagagtgggtctcaggtattgagggtcctggtgatgttacatactacgcagactccgtgaagggccggttcaccatctcccgcgacaattccaagaacacgctgtatctgcaaatgaacagcctgcgtgccgaggacaccgcggtatattactgtgcgaaagttgggaaggagagtaattctgactaccggggtcaggggaccctggtcaccgtctcgagc

SEQ ID NO: 707 - DNA, 354 bp, Artificial Sequence
  Description of Artificial Sequence: Synthetic polynucleotide
gaggtgcagctgttggagtctgggggaggcttggtacagcctggggggtccctgcgtctcacctgtgcagcctccggattcacctttaattggcagctgatgggttgggtccgccaggctccagggaagggtctagagtgggtctcgggtattgagggtcctggtgatgttacatactacgcagactccgtgaagggccggttcatcatctcccgcgacaattccaagaacacgctatatctgcaaatgaacagcctgcgtgccgaggacaccgcggtatattactgtgcgaaagttgggaaggagagtaattctgactaccggggtcagggaaccctggtcaccgtctcgagc

SEQ ID NO: 708 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaattggcagctgatgggttgggtccgccaggctccagggaagggtctagagtgggtctcaggtattgagggtcctggtgatgttacatactacgcggactccgtgaagggccggttcaccatctcccgcgacaattccacgaacacgctgtatctgcaaatgaacagcctgcgtgccgaggacaccgcggtatattactgtgcgaaagttgggaaggagagtgaatttgactaccggggtcagggaaccctggtcaccgtctcgagc

SEQ ID NO: 709 - DNA, 354 bp, Artificial Sequence
  Description of Artificial Sequence: Synthetic polynucleotide
gaggtgcggctgttggagtctgggggaggcttggtacagcctggggggtccctgcgtctctcctgtgcagcctccggattcacctttaattggcagctgatgggttgggtccgccaggctccagggaagggtctagagtgggtctcaggtattgagggtcctggtgatgttacatactacgcagactccgtgaagggccggttcaccatcacccgcgacaattccaagaacacgctgtatctgcaaatgaacagcctgcgtgccgaggacaccgcggtatattactgtgtgaaagttgggaaggagagtaatcttgactaccggggtcagggaaccctggtcaccgtctcgagc

SEQ ID NO: 710 - DNA, 354 bp, Artificial Sequence
  Description of Artificial Sequence: Synthetic polynucleotide
gaggtgcagctgttggtgtctgggggaggcctggtacagcctggggggtccctgcgtctctcctgtgcagcctccggattcacctttaattggcagctgatgggttgggtccgccaggctccagggaagggtctagagtgggtctcaggtattgagggtcctggtgatgttacatactacgcagactccgtgaagggccggttcaccatctcccgcgacaattccaagaacacgctgtatctgcaaatgaacagcctgcgtgccgaggacaccgcggtatattactgtgcgaaagttgggaaggagagtaattttgactaccggggtcagggaaccctggtcaccgtctcgagc

SEQ ID NO: 711 - DNA, 354 bp, Artificial Sequence
  Description of Artificial Sequence: Synthetic polynucleotide
gaggtgcagctgttggtgtctgggggaggcttggtacagcctggggggtccctgcgtctctcctgtgcagcctccggattcacctttaattggcagctgatgggttgggtccgccaggctccagggaagggtctagagtgggtctcaggtattgagggtcctggtgatgttacatactacgcagactccgtgaagggccggttcaccatctcccgcgacaattccaagaacatgctgtatctgcaaatgaacggcctgcgtgccgaggacaccgcggtatattactgtgcgaaagttgggaaggagagtaattttgactaccggggtcagggaaccctggtcaccgtctcgagc

SEQ ID NO: 712 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaattggcagctgatgggttgggtccggcaggctccagggaagggtctagagtgggtctcaggtattgagggtccaggtgatgttacatactacgcagactccgtgaagggccggttcaccatctcccgcgacaattccaagaacacgctgtatctgcaaatgaacagcctgcgtgccgaggacaccgcggtatattactgtgtgaaagttgggaaggagagtaattctgactaccggggtcagggaaccctggtcaccgtatcgagc

SEQ ID NO: 713 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaagtggcagctcatggggtgggcccggcaggctccagggaagggtctagagtgggtctcaggtattgagggtccaggtgatgttacatactacgcagaccccgtgaagggccggttcaccatctcccgcgacaattccaagaacacgctgtatctgcaaatgaacagcctgcgtgccgaggacaccgcggtatattactgtgtgaaagttgggaaggagagtaattctgactaccggggtcagggaaccctggtcaccgtatcgagc

SEQ ID NO: 714 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaagtggcacctgatggggtgggtccggcaggctccagggaagggtctagagtgggtctcaggtattgagggtccaggtgatgttacatactacgcagactccgtgaagggccggttcaccatctcccgcgacaattccaagaacacgctgtatctgcaaatgaacagcctgcgtgccgaggacaccgcggtatattactgtgtgaaagttgggaaggagagtagttctgactaccggggtcagggaaccctggtcaccgtatcgagc

SEQ ID NO: 715 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaactggcacctgatggcctgggcccggcaggctccagggaagggtctagagtgggtctcaggtattgagggtccaggtgatgttacatactacgcagactccgtgaagggccggttcaccatctcccgcgacaattccaagaacacgctgtatctgcaaatgaacagcctgcgtgccgaggacaccgcggtatattactgtgtgaaagttgggaaggagagtaattctgactaccggggtcagggaaccctggtcaccgtatcgagc

SEQ ID NO: 716 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaagtggcagctgatgggctgggtccggcaggctccagggaagggtctcgagtgggtctcaggtattgagggtccaggtgatgttacatactacgcagactccgtgaagggccggttcaccatctcccgcgacaattccaagaacacgctgtatctgcaaatgaacagcctgcgtgccgaggacaccgcggtatattactgtgtgaaagttgggaaggagagtaattctgactaccggggtcagggaaccctggtcaccgtatcgagc

SEQ ID NO: 717 - DNA, 354 bp, Artificial Sequence
  Description of Artificial Sequence: Synthetic polynucleotide
gaggtgcagctgttggagtctgggggaggcttggtgcagcctggggggtccctgcgtctctcctgtgcagcctccggattcacctttaagtggcagctgatggcctgggcccggcaggctccagggaagggtctagagtgggtctcaggtattgagggtccaggtgatattacatactacgcagactccgtgaagggccggttcaccatctcccgcgacaattccaagaacacgctgtatctgcaaatgaacagcctgcgtgccgaggacaccgcggtatattactgtgtgaaagttgggaaggagagtaattctgactaccggggtcagggaaccctggtcaccgtatcgagc

SEQ ID NO: 718 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaactggcacttgatgggctgggcccggcaggctccagggaagggtctagagtgggtctcaggtattgagggtccaggtgatgttacatactacgcagactccgtgaagggccggttcaccatctcccgcgacaattccaagaacacgctgtatctgcaaatgaacagcctgcgtgccgaggacaccgcggtatattactgtgtgaaagttgggaaggagagtaattctgactaccggggtcagggaaccctggtcaccgtatcgagc

SEQ ID NO: 719 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaagtggcagctcatggggtgggcccggcaggctccagggaagggtctagagtgggtctcaggtattgagggtccaggtgatgttacatactacgcagactccgtgaagggccggttcaccatctcccgcgacaattccaagaacacgctgtatctgcaaatgaacagcctgcgtgccgaggacaccgcggtatattactgtgtgaaagttgggaaggagagtaattctgactaccggggtcagggaaccctggtcaccgtatcgagc

SEQ ID NO: 720 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaactgggagctgatgggctgggcccggcaggctccagggaagggtctagagtgggtctcaggtattgagggtccaggtgatgttacatactacgcagactccgtgaagggccggttcaccatctcccgcgacaattccaagaacacgctgtatctgcaaatgaacagcctgcgtgccgaggacaccgcggtatattactgtgtgaaagttgggaaggagagtaattctgactaccggggtcagggaaccctggtcaccgtatcgagc

SEQ ID NO: 721 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaactggcagctcatgggctgggcccggcaggctccagggaagggtctagagtgggtctcaggtattgagggtccaggtgatgttacatactacgcagactccgtgaagggccggttcaccatctcccgcgacaattccaagaacacgctgtatctgcaaatgaacagcctgcgtgccgaggacaccgcggtatattactgtgtgaaagttgggaaggagagtaattctgactaccggggtcagggaaccctggtcaccgtatcgagc

SEQ ID NO: 722 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaattggcagctgatgggttgggtccggcaggctccagggaagggtctagagtgggtctcaggtattgagggtccaggtgatgttacatactacgcagactccgtgaagggccggttcaccatctcccgcgacaattccaagaacacgctgtatctgcaaatgaacagcctgcgtgccgaggacaccgcggtatattactgtgtgaaagtgggcaaggacagcaagtccgactaccggggtcagggaaccctggtcaccgtatcgagc

SEQ ID NO: 723 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaattggcagctgatgggttgggtccggcgggctccagggaagggtctagagtgggtctcaggtattgagggtccaggtgatgttacatactacgcagactccgtgaagggccggttcaccatctcccgcgacaattccaagaacacgctgtatctgcaaatgaacagcctgcgtgccgaggacaccgcggtatattactgtgtgaaagtcgggaaggacagcaagtcggactaccggggtcagggaaccctggtcaccgtatcgagc

SEQ ID NO: 724 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaattggcagctgatgggttgggtccggcaggctccagggaagggtctagagtgggtctcaggtattgagggtccaggtgatgttacatactacgcagactccgtgaagggccggttcaccatctcccgcgacaattccaagaacacgctgtatctgcaaatgaacagcctgcgtgccgaggacaccgcggtatattactgtgtgaaagtcgggaaggacagcaactcggactaccggggtcagggaaccctggtcaccgtatcgagc

SEQ ID NO: 725 - DNA, 354 bp, Artificial Sequence
  Description of Artificial Sequence: Synthetic polynucleotide
gaggtgcagctgttggagtctgggggaggcttggcacagcctggggggtccctgcgtctctcctgtgcagcctccggattcacctttaattggcagctgatgggttgggtccggcaggctccagggaagggtctagagtgggtctcaggtattgagggtccaggtgatgttacatactacgcagactccgtgaagggccggttcaccatctcccgcgacaattccaagaacacgctgtatctgcaaatgaacagcctgcgtgccgaggacaccgcggtatattactgtgtgaaagtgggcaaggacagcaagtccgactaccggggtcagggaaccctggtcaccgtatcgagc

SEQ ID NO: 726 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaattggcagctgatgggttgggtccggcaggctccagggaagggtctagagtgggtctcaggtattgagggtccaggtgatgttacatactacgcagactccgtgaagggccggttcaccatctcccgcgacaattccaagaacacgctgtatctgcaaatgaacagcctgcgtgccgaggataccgcggtatattactgtgtgaaagtggggaaggacgccaagtcggactaccggggtcagggaaccctggtcaccgtatcgagc

SEQ ID NO: 727 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaattggcagctgatgggttgggtccggcaggctccagggaagggtctagagtgggtctcaggtattgagggcccaggtgatgttacatactacgcagactccgtgaagggccggttcaccatctcccgcgacaattccaagaacacgctgtatctgcaaatgaacagcctgcgtgccgaggataccgcggtatattactgtgtgaaagtggggaaggacaagaactcggactaccggggtcagggaaccctggtcaccgtatcgagc

SEQ ID NO: 728 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaattggcagctgatgggttgggtccggcaggctccagggaagggtctagagtgggtctcaggtattgagggtccaggtgatgttacatactacgcagactccgtgaagggccggttcaccatctcccgcgacaattccaagaacacgctgtatctgcaaatgaacagcctgcgtgccgaggataccgcggtatattactgtgtgaaagtggggaaggagagcaagtccgactaccggggtcagggaaccctggtcaccgtatcgagc

SEQ ID NO: 729 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaattggcagctgatgggttgggtccggcaggctccagggaagggtctagagtgggtctcaggtattgagggtccaggtgatgttacatactacgcagactccgtgaagggccggttcaccatctcccgcgacaattccaagaacacgctgtatctgcaaatgaacagcctgcgtgccgaggataccgcggtatattactgtgtgaaagtggggagggacagcaagtcggactaccggggtcagggaaccctggtcaccgtatcgagc

SEQ ID NO: 730 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaattggcagctgatgggttgggtccggcaggctccagggaagggtctagagtgggtctcaggtattgagggtccaggtgatgttacatactacgcggactccgtgaagggccggttcaccatctcccgcgacaattccaagaacacgctgtatctgcaaatgaacagcctgcgtgccgaggataccgcggtatattactgtgtgaaagtcgggaagtacagcaactcggactaccggggtcagggaaccctggtcaccgtatcgagc

SEQ ID NO: 731 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaattggcagctgatgggttgggtccggcaggctccagggaagggtctagagtgggtctcaggtattgagggtccaggtgatgttacatactacgcagactccgtgaagggccggttcaccatctcccgcgacaattccaagaacacgctgtatctgcaaatgaacagcctgcgtgccgaggacaccgcggtatattactgtgtgaaagtgggcaaggacagcaggtcggactaccggggtcagggaaccctggtcaccgtatcgagc

SEQ ID NO: 732 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaattggcagctgatgggttgggtccggcaggctccagggaagggtctagagtgggtctcaggtattgagggtccaggtgatgttacatactacgcagactccgtgaagggccggttcaccatctcccgcgacaattccaagaacacgctgtatctgcaaatgaacagcctgcgtgccgaggacaccgcggtatattactgtgtgaaagtggggaaggacgacagctcggactaccggggtcagggaaccctggtcaccgtatcgagc

SEQ ID NO: 733 - DNA, 354 bp, Artificial Sequence
  Description of Artificial Sequence: Synthetic polynucleotide
gaggtgcagctgttggagtttgggggaggcttggtacagcctggggggtccttgcgtttttcctgtgcagcttccggattcacctttaattggcagctgatgggttggttccggcaggctccagggaagggtttagagtgggtttcaggtattgagggtccaggtgatgttacatattacgcagattccgtgaagggccggttcaccatttcccgcgacaattccaagaacacgctgtatctgcaaatgaacagcttgcgtgccgaggataccgcggtatattactgtgtgaaagtggggagggacagcaattccgactaccggggtcagggaaccctggtcaccgtatcgagc

SEQ ID NO: 734 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaattggcagctgatgggttgggtccggcaggctccagggaagggtctagagtgggtctcaggtattgagggtccaggtgatgttacatactacgcagactccgtgaagggccggttcaccatctcccgcgacaattccaagaacacgctgtatctgcaaatgaacagcctgcgtgccgaggacaccgcggtatattactgtgtgaaagtggggaaggacagcacctcggactaccggggtcagggaaccctggtcaccgtatcgagc

SEQ ID NO: 735 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaattggcagctgatgggttgggtccggcaggctccagggaagggtctagagtgggtctcaggtattgagggtccaggtgatgttacatactacgcagactccgtgaagggccggttcaccatctcccgcgacaattccaagaacacgctgtatctgcaaatgaacagcctgcgtgccgaggacaccgcggtatattactgtgtgaaagtggggaaggagagcagctcggactaccggggtcagggaaccctggtcaccgtatcgagc

SEQ ID NO: 736 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaattggcagctgatgggttgggtccggcaggctccagggaagggtctagagtgggtctcaggtattgagggtccaggtgatgttacatactacgcagactccgtgaagggccggttcaccatcttccgcgacaattccaagaacacgctgtatctgcaaatgaacagcctgcgtgccgaggataccgcggtatattactgtgtgaaagtgggcaaggacagcgcgtccgactaccggggtcagggaaccctggtcaccgtatcgagc

SEQ ID NO: 737 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaattggcagctgatgggttgggtccggcaggctccagggaagggtctagagtgggtctcaggtattgagggtccaggtgatgttacatactacgcagactccgtgaagggccggttcaccatctcccgcgacaattccaagaacacgctgtatctgcaaatgaacagcctgcgtgccgaggataccgcggtatattactgtgtgaaagtcggcaacgacagctactcggactaccggggtcagggaaccctggtcaccgtatcgagc

SEQ ID NO: 738 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctctggattcacctttaattggcagctgatgggttgggtccggcaggctccagggaagggtctagagtgggtctcaggtattgagggtccaggtgatgttacatactacgcagactccgtgaagggccggttcaccatctcccgcgacaattccaagaacacgctgtatctgcaaatgaacggcctgcgtgccgaggacaccgcggtatattactgtgtgaaagtggggaaggacagcagctcggactaccggggtcagggaaccctggtcaccgtatcgagc

SEQ ID NO: 739 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaattggcagctgatgggttgggtccggcaggctccagggaagggtctagagtgggtctcaggtattgagggtccaggtgatgttacatactacgcagactccgtgaagggccggttcaccatctcccgcgacaattccaagaacacgctgtatctgcaaatgaacagcctgcgtgccgaggacaccgcgatatattactgtgtgaaagtgggcaaggacagcgcgtcggactaccggggtcagggaaccctggtcaccgtatcgagc

SEQ ID NO: 740 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaagtggcagctgatgggctgggtccggcaggctccagggaagggtctagagtgggtctcaggtattgagggtccaggtgatgttacatactacgcagactccgtgaagggccggttcaccatctcccgcgacaattccaagaacacgctgtatctgcaaatgaacagcctgcgtgccgaggataccgcggtatattactgtgtgaaagtggggaaggacgccaagtcggactaccggggtcagggaaccctggtcaccgtatcgagc

SEQ ID NO: 741 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaagtggcagctgatgggctgggtccggcaggctccagggaagggtctagagtgggtctcaggtattgagggtccaggtgatgttacatactacgcagactccgtgaagggccggttcaccatctcccgcgacaattccaagaacacgctgtatctgcaaatgaacagcctgcgtgccgaggacaccgcggtatattactgtgtgaaagtgggcaaggacagcaggtcggactaccggggtcagggaaccctggtcaccgtatcgagc

SEQ ID NO: 742 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaagtggcagctgatgggctgggtccggcaggctccagggaagggtctagagtgggtctcaggtattgagggtccaggtgatgttacatactacgcagactccgtgaagggccggttcaccatctcccgcgacaattccaagaacacgctgtatctgcaaatgaacagcctgcgtgccgaggacaccgcggtatattactgtgtgaaagtgggcaaggacagcaagtccgactaccggggtcagggaaccctggtcaccgtatcgagc

SEQ ID NO: 743 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaactgggagctgatgggctgggcccggcaggctccagggaagggtctagagtgggtctcaggtattgagggtccaggtgatgttacatactacgcagactccgtgaagggccggttcaccatctcccgcgacaattccaagaacacgctgtatctgcaaatgaacagcctgcgtgccgaggataccgcggtatattactgtgtgaaagtggggaaggacgccaagtcggactaccggggtcagggaaccctggtcaccgtatcgagc

SEQ ID NO: 744 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaactgggagctgatgggctgggcccggcaggctccagggaagggtctagagtgggtctcaggtattgagggtccaggtgatgttacatactacgcagactccgtgaagggccggttcaccatctcccgcgacaattccaagaacacgctgtatctgcaaatgaacagcctgcgtgccgaggacaccgcggtatattactgtgtgaaagtgggcaaggacagcaggtcggactaccggggtcagggaaccctggtcaccgtatcgagc

SEQ ID NO: 745 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaactgggagctgatgggctgggcccggcaggctccagggaagggtctagagtgggtctcaggtattgagggtccaggtgatgttacatactacgcagactccgtgaagggccggttcaccatctcccgcgacaattccaagaacacgctgtatctgcaaatgaacagcctgcgtgccgaggacaccgcggtatattactgtgtgaaagtgggcaaggacagcaagtccgactaccggggtcagggaaccctggtcaccgtatcgagc

SEQ ID NO: 746 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaattggcagctgatgggatgggcccgccaggctccagggaagggtctagagtgggtctcaggtattgagggtcctggtgatgttacatactacgcagactccgtgaagggtcggttcaccatctcccgcgacaattccaagaacacgctgtatctacaaatgaacagcctgcgtgccgaggactccgcggtatattactgtgcgaaagttgggaaggagagtaattttgactacctgggtcagggaaccctggtcaccgtctcgagc

SEQ ID NO: 747 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgtagcctccggattcacctttaattggcagctgatgggttgggtccgccaggcgccagggaagggtctagagtgggtctcaggtattgagggtcctggtgatgttacatactacgcagactccgtgaagggccggttcaccatctcccgcgacaattccaagaacacgctgtatctgcaaatgaacagcctgcgtgccgaggacaccgcggtatattactgtgcgaaagtcgggaaggagagtaattctgactaccggggtcagggaaccctggtcaccgtttcgagc

SEQ ID NO: 748 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaattggcagctgatgggttgggtccgccaggctccagggaagggtctagagtgggtctcaggtattgagggtcctggtgatgttacatactacgcagactccgtgaagggccggttcaccatctcccgcgacaattccaagaacacgctgtatctgcaaatgaacagcctgcgtgccgaggacaccgcggtatattactgtgcgaaagttgggaaggagagtaattctgactaccggggtcagggaaccctggtcaccgtctcgagc

SEQ ID NO: 749 - DNA, 360 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttagtgggtgggagatgggttgggtccgccaggctccagggaagggtctagagtgggtctcatctattgatgagtctggtcttaatacatactacgcagactccgtgaagggccggttcaccatctcccgcgacaattccaagaacacgctgtatctgcaaatgaacagcctgcgtgccgaggacaccgcggtatattactgtgcggaaggtgcgccgcagtatcagattacatttgactactggggtcagggaaccctggtcaccgtctcgagc

SEQ ID NO: 750 - DNA, 360 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcctaattatgggatgtattgggtccgccaggctccagggaagggtctagagtgggtctcatatatttcgcggaggggtttgttgacatactacgcagactccgtgaagggccggttcaccatctcccgcgacaattccaagaacacgctgtatctgcaaatgaacagcctgcgtgccgaggacaccgcggtatattactgtgcgaaaacgtcgcattatatgaataatgggtttgactactggggtcagggaaccctggtcaccgtctcgagc

SEQ ID NO: 751 - DNA, 369 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgtggattatacgatggcttgggtccgccaggctccagggaagggtctggagtgggtctcatctattagtccgattggtacttttacatactacgcagactccgtgaagggccggttcaccatctcccgcgacaattccaagaacacgctgtatctgcaaatgaacagcctgcgtgccgaggacaccgcggtatattactgtgcgaaagatccttatgggatggaggatggtctgacgtggtttgactactggggtcagggaaccctggtcaccgtctcgagc

SEQ ID NO: 752 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgatgcgtatgatatgcagtgggtccgccaggctccagggaagggtctggagtgggtctcaacgattacgtcggagggtctttctacatactacgcagactccgtgaagggccggttcaccatctcccgcgacaattccaagaacacgctgtatctgcaaatgaacagcctgcgtgccgaggataccgcggtatattactgtgcgaaacctagtgatttgtttgactactggggtcagggaaccctggtcaccgtctcgagc

SEQ ID NO: 753 - DNA, 363 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgatgggtatgatatgggttgggtccgccaggctccagggaagggtctagagtgggtctcaactatttctcgtgggggttggttcacatactacgcagactccgtgaagggccggttcaccatctcccgcgacaattccaagaacacgctgtatctgcaaatgaacagcctgcgtgccgaggacaccgcggtatattactgtgcgaaagggacgagtcagtcgtctacggggagttttgactactggggtcagggaaccctggtcaccgtctcgagc

SEQ ID NO: 754 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgtcggtatgatatgctttgggcccgccaggctccagggaagggtctagagtgggtctcagagatttcgcctacgggtgctcttacatactacgcagactccgtgaagggccggttcaccatctcccgcgacaattccaagaacacgctgtatctgcaaatgaacagcctgcgtgccgaggataccgcggtatattactgtgcgaaacttggttcgacttttgactactggggtcagggaaccctggtcaccgtctcgagc

SEQ ID NO: 755 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcaccttttttccgtattatatgagttgggtccgccaggctccagggaagggtctagagtgggtctcatctatttcgggtacgggtgggcttacatactacgcagactccgtgaagggccggttcaccatctcccgcgacaattccaagaacacgctgtatctgcaaatgaacagcctgcgtgccgaggacaccgcggtatattactgtgcgaaaacgacgcagaatgcgacgctttttgactactggggtcagggaaccctggtcaccgtctcgagc

SEQ ID NO: 756 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgaggtttatactatggcgtgggtccgccaggctccagggaagggtctggagtgggtctcaacgattgatgagtctggtcgtgatacatactacgcagactccgtgaagggccggttcaccatctcccgcgacaattccaagaacacgctgtatctgcaaatgaacagcctgcgtgccgaggacaccgcggtatattactgtgcgaaacctggtgtttggtttgactactggggtcagggaaccctggtcaccgtctcgagc

SEQ ID NO: 757 - DNA, 372 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgcgttttataagatggggtgggtccgccaggctccagggaagggtctagagtgggtctcaacgattactcctaagggtcatcatacatactacgcagactccgtgaagggccggttcaccatctcccgcgacaattccaagaacacgctgtatctgcaaatgaacagcctgcgtgccgaggacaccgcggtatattactgtgcgaaagtttttaagggtaagggttggactcgtccgagtgggtttgactactggggtcagggaaccctggtcaccgtctcgagc

SEQ ID NO: 758 - DNA, 360 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaatgagtatagtatgatgtgggtccgccaggctccagggaagggtctagagtgggtctcatctattgggaggcgtggttggcttacatactacgcagactccgtgaagggccggttcaccatctcccgcgacaattccaagaacacgctgtatctgcaaatgaacagcctgcgtgccgaggacaccgcggtatattactgtgcgaaagctgtgctgctggattctactaagtttgactactggggtcagggaaccctggtcaccgtctcgagc

SEQ ID NO: 759 - DNA, 363 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgatgagtatccgatgacttgggtccgccaggctccagggaagggtctagagtgggtctcaactatttctgcgcgtggtccttttacatactacgcagactccgtgaagggccggttcaccatctcccgcgacaattccaagaacacgctgtatctgcaaatgaacagcctgcgtgccgaggacaccgcggtatattactgtgcgaaaggtaggcattggcttcgtaatggtcgttttgactactggggtcagggaaccctggtcaccgtctcgagc

SEQ ID NO: 760 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttggtatgcagtcgatgcagtgggtccgccaggctccagggaagggtctagagtgggtctcaagtattactgatgatggtactagtacatactacgcagactccgtgaagggccggttcaccatctcccgcgacaattccaagaacacgctgtatctgcaaatgaacagcctgcgtgccgaggacaccgcggtatattactgtgcgaaacctgatcgggtttttgactactggggtcagggaaccctggtcaccgtctcgagc

SEQ ID NO: 761 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttggggcggctgatatgcagtgggtccgccaggctccagggaagggtctagagtgggtctcactgattactaatgatggtatttctacatactacgcagactccgtgaagggccggttcaccatctcccgcgacaattccaagaacacgctgtatctgcaaatgaacagcctgcgtgccgaggacaccgcggtatattactgtgcgaaagcgggtgatcgttttgactactggggtcagggaaccctggtcaccgtctcgagc

SEQ ID NO: 762 - DNA, 363 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaataagtataggatgcagtgggtccgccaggctccagggaagggtctagagtgggtctcaagtattgatagttctggtgagctgacatactacgcagactccgtgaagggccggttcaccatctcccgcgacaattccaagaacacgctgtatctgcaaatgaacagcctgcgtgccgaggacaccgcggtatattactgtgcggaagaggttccgatggggaatcagactttttttgactactggggtcagggaaccctggtcaccgtctcgagc

SEQ ID NO: 763 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttactgattatactatggggtgggtccgccaggctccagggaagggtctagagtgggtctcatcgattacgtctcagggtgcttttacatactacgcagactccgtgaagggccggttcaccatctcccgcgacaattccaagaacacgctgtatctgcaaatgaacagcctgcgtgccgaggacaccgcggtatattactgtgcgaaagctacgggtacggattcgtcgtttgactactggggtcagggaaccctggtcaccgtctcgagc

SEQ ID NO: 764 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgaggattatgagatgtcttgggtccgccaggctccagggaagggtctggagtgggtctcatgtattgggccggggggtaagcctacatactacgcagactccgtgaagggccggttcaccatctcccgcgacaattccaagaacacgctgtatctgcaaatgaacagcctgcgtgccgaggacaccgcggtatattactgtgcgaaagtggatgggcattttgactactggggtcagggaaccctggtcaccgtctcgagc

SEQ ID NO: 765 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttagtcagtatgatatggggtgggtccgccaggctccagggaagggtctagagtgggtctcaacgatttcttcgaggggttggcttacatactacgcagactccgtgaagggccggttcaccatctcccgcgacaattccaagaacacgctgtatctgcaaatgaacagcctgcgtgccgaggacaccgcggtatattactgtgcgaaaggtccggggggtcgtcggcggtttgactactggggtcagggaaccctggtcaccgtctcgagc

SEQ ID NO: 766 - DNA, 372 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttctggattatgcgatgggttgggtccgccaggctccagggaagggtctggagtgggtctcaactatttctccgatgggtatgggtacatactacgcagactccgtgaagggccggttcaccatctcccgcgacaattccaagaacacgctgtatctgcaaatgaacagcctgcgtgccgaggacaccgcggtatattactgtgcgaaatcgagtgctatttcgtttacttctgatatttctaattttgactactggggtcagggaaccctggtcaccgtctcgagc

SEQ ID NO: 767 - DNA, 369 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttagtgattatccgatgtcttgggtccgccaggctccagggaagggtctagagtgggtctcaagtatttcttggtctggttttcagacatactacgcagactccgtgaagggccggttcaccatctcccgcgacaattccaagaacacgctgtatctgcaaatgaacagcctgcgtgccgaggataccgcggtatattactgtgcgaaacctggtgttgcgaggatgcctactgggattgcttttgactactggggtcagggaaccctggtcaccgtctcgagc

SEQ ID NO: 768 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttagtgcttatgagatgcagtgggtccgccaggctccagggaagggtctagagtgggtctcatctattgatagtgctggtacttttacatactacgcagactccgtgaagggccggttcaccatctcccgcgacaattccaagaacacgctgtatctgcaaatgaacagcctgcgtgccgaggacaccgcggtctattactgtgcggaaccttttgggatgtttgactactggggtcagggaaccctggtcaccgtctcgagc

SEQ ID NO: 769 - DNA, 372 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcaccttttcggagtatccgatgaagtgggtccgccaggctccagggaagggtctagagtgggtctcaacgattgatcggcagggtgatcggacatactacgcagactccgtgaagggccggttcaccatctcccgcgacaattccaagaacacgctgtatctgcaaatgaacagcctgcgtgccgaggacaccgcggtatattactgtgcgaaaacggtgcggaggggtcttcctcgtccgagtcgttattttgactactggggtcagggaaccctggtcaccgtctcgagc

SEQ ID NO: 770 - DNA, 363 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttagtgattatgatatgggttgggtccgccaggctccagggaagggtctggagtgggtctcaagtatttcgcctatgggtacgtttacatactacgcagactccgtgaagggccggttcaccatctcccgcgacaattccaagaacacgctgtatctgcaaatgaacagcctgcgtgccgaggacaccgcggtatattactgtgcgaaaggtctgagtgtgtattcgggtcttgattttgactactggggtcagggaaccctggtcaccgtctcgagc

SEQ ID NO: 771 - DNA, 369 bp, Artificial Sequence
  Description of Artificial Sequence: Synthetic polynucleotide
gaggtgcagctgttggagtctgggggaggcctggtacagcctggggggtccctgcgtctctcctgcgcagcctccggattcaccttttctcattatgatatgggttgggtccgccaggctccagggaagggtctggagtgggtctcagatattgattatattggtaagactacatactacgcagactccgtgaagggccggttcaccatctctcgcgacaattccaagaacacgctgtatctgcaaatgaacagcctgcgtgccgaggacaccgcggtatattactgtgcgaaagcttcggatgaggtgggtgttaatacttccaagtttgactactggggtcagggaaccctggtcaccgtctcgagc

SEQ ID NO: 772 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgcgcggtatgatatggggtgggtccgccaggctccagggaagggtctagagtgggtctcaactatttctcctactggtgtgttgacatactacgcagactccgtgaagggccggttcaccatctcccgcgacaattccaagaacacgctgtatctgcaaatgaacagcctgcgtgccgaggacaccgcggtatattactgtgcgaaaggttttgaggattttgactactggggtcagggaaccctggtcaccgtctcgagc

SEQ ID NO: 773 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgaggcttatccgatgagttgggtccgccaggctccagggaagggtctagagtgggtctcactgatttctcatacgggtcatgctacatactacgcagactccgtgaagggccggttcaccatctcccgcgacaattccaagaacacgctgtatctgcaaatgaacagcctgcgtgccgaggacaccgcggtatattactgtgcgaaagggcattggccttttgactaccggggtcagggaaccctgatcaccgtctcgagc

SEQ ID NO: 774 - DNA, 357 bp, Artificial Sequence
  Description of Artificial Sequence: Synthetic polynucleotide
gaggtgcagctgttggagtctgggggaggcttggtacagccaggggggtccctgcgcctctcctgtgcagcctccggattcacctttgaggatgagtggatgagttgggtccgccaggctccagggaagggtctagagtgggtctcagatattagcccgggtggttggactacatactacgccgactccgtgaagggccggttcaccatctcccgcgacaattccaagaacacgctgtatctgcaaatgaacagcctgcgtgccgaggacaccgcggtatattactgtgcgaaaggttatcgtccgtttgatgagtttgactactggggtcagggaaccctggtcaccgtctcgagc

SEQ ID NO: 775 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggagtcacctttgatgctattgagatgtcttgggtccgccaggctccagggaagggtctggagtgggtctcatcgatttcgcgtcatggtgagtatacatactacgcagactccgtgaagggccggttcaccatctcccgcgacaattccaagaacacgctgtatctgcaaatgaacagcctgcgtgccgaggacaccgcggtatattactgtgcggaagatgcttggtctcggcattttgactactggggtcagggaaccctggtcaccgtctcgagc

SEQ ID NO: 776 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgatagtacggatatgagttgggtccgccaggctccagggaagggtctagagtgggtctcaggtattttggataatggtagtaatacatactacgcagactccgtgaagggccggttcaccatctcccgcgacaattccaagaacatgctgtatctgcaaatgaatagcctgcgtgccgaggataccgcggtatattactgtgcgaaaggggcgagggattttgactactggggtcagggaaccctggtcaccgtctcgagc

SEQ ID NO: 777 - DNA, 351 bp, Artificial Sequence
  Description of Artificial Sequence: Synthetic polynucleotide
gaggtgcagctgttggagtctgggggaggcttggtacagcctggggggtccctgcgtctctcctgtgcagcttccggattcacctttggtaggcagagtatgcagtgggtccgccaggctccagggaagggtctagagtgggtctcaagtattgatgatgatggtttttcgacatactacgcagactccgtgaagggccggttcaccatctcccgcgacaattccaagaacacgctgtatctgcaaatgaacagcctgcgtgccgaggacaccgcggtatattactgtgcgaaaggggatccgtggggttttgactactggggtcagggaaccctggtcaccgtctcgagc

SEQ ID NO: 778 - DNA, 348 bp, Artificial Sequence
  Description of Artificial Sequence: Synthetic polynucleotide
gaggtgcagctgttggagtctgggggaggcttggtacagcctggggggtccctgcgtctctcctgtacagcctccggattcacctttagtgatacgcagatggcgtgggtccgccaggctccagggaagggtctagagtgggtctcaggtattgatgatgggggtgtgagtacatactacgcagactccgtgaagggccggttcaccatctcccgcgacaattccaagaacacgctgtatctgcaaatgaacagcctgcgtgccgaggacaccgcggtatattactgtgcgaaaccggatcgtcattttgactactggggtcagggaaccctggtcaccgtctcgagc

SEQ ID NO: 779 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgggagtacgacgatggggtgggtccgccaggctccagggaagggtctggagtgggtctcagtgatttcggatgatggtggttttacatactacgcagactccgtgaagggccggttcaccatctcccgcgacaattccaggaacacgctgtatctgcaaatgaacagcctgcgtgccgaggacaccgcggtatattactgtgcgaaagttgatggttatggtgtttttgactactggggtcagggaaccctggtcaccgtctcgagc

SEQ ID NO: 780 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcggagtggggatatgaattgggtccgccaggctccagggaagggtctagagtgggtctcaactattacgaatgatggtacgtctacatactacgcagactccgtgaagggccggttcaccatctcccgcgacaattccaagaatacgctgtatctgcaaatgaacagcctgcgtgccgaggacaccgcggtatattactgtgcgaaatctgattctgattttgactactggggtcagggaaccctggtcaccgtctcgagc

SEQ ID NO: 781 - DNA, 360 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgctgcttatgctatgacgtgggtccgccaggctccagggaagggtctagagtgggtctcatatattagtccgaatggtacggcgacatactacgcagactccgtgaagggccggttcaccatctcccgcgacaattccaagaacacgctgtatctgcaaatgaacagcctgcgtgccgaggacaccgcggtatattactgtgcggaatatgtggggatgcgttggaattcttttgactactggggtcagggaaccctggtcaccgtctcgagc

SEQ ID NO: 782 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcaccttttcgagttatgagatggcttgggtccgccaggctccagggaagggtctagagtgggtctcatctattacgagtcttggtacttctacatactacgcagactccgtgaagggccggttcaccatctcccgcgacaattccaagaacacgctgtatctgcaaatgaacagcctgcgtgccgaggacaccgcggtatattactgtgcgaaaccgggtaggaagtttgactactggggtcagggaaccctggtcaccgtctcgagc

SEQ ID NO: 783 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaatgagtatgagatgacgtgggtccgccaggctccagggaagggtctagagtgggtctcaacgattactagtgagggtagtgggacatactacgcagactccgtaaagggccggttcaccatctcccgcgacaattccaagaacacgctgtatctgcaaatgaacagcctgcgtgccgaggacaccgcggtatattactgtgcgaaacctaatggtaagtttgactactggggtcagggaaccctggtcaccgtctcgagc

SEQ ID NO: 784 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcaccttttctgattatgagatgttgtgggtccgccaggctccagggaagggtctggagtgggtctcaactattactagtgagggtcattctacatactacgcagactccgtgaagggccggttcaccatctcccgcgacaattccaagaacacgctgtatctgcaaatgaacagcctgcgtgccgaggacaccgcggtatattactgtgcgaaacctgggacttcgtttgactactggggtcagggaaccctggtcaccgtctcgagc

SEQ ID NO: 785 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttagtgattatgagatgagttgggtccgccaggctccagggaagggtctagagtgggtctcaacgattgattctgatggtagttttacatactacgcagactccgtgaagggccggttcaccatctcccgcgacaattccaagaacacgctgtatctgcaaatgaacagcctgcgtgccgaggacaccgcggtatattactgtgcgaaaccgggtgtgaagtttgactactggggtcagggaaccctggtcaccgtctcgagc

SEQ ID NO: 786 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaaggattatgagatgacttgggtccgccaggctccagggaagggtctagagtgggtctcatctatttcttctactggtcagtctacatactacgcagactccgtgaagggccggttcaccatctcccgcgacaattccaagaacacgctgtatctgcaaatgaacagcctgcgtgccgaggacaccgcggtatattactgtgcgaaaccgggtaataagtttgactactggggtcagggaaccctggtcaccgtctcgagc

SEQ ID NO: 787 - DNA, 372 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcttgattatggtatggcttgggtccgccaggctccagggaagggtctagagtgggtctcagctatttcgcctcttggtcttagtacatactacgcagactccgtgaagagccggttcaccatctcccgcgacaattccaagaacacgctgtatctgcaaatgaacagcctgcgtgccgaggataccgcggtatattactgtgcgaaagaggtgagggtgggtaggggtgttcatcctccgaagtttgactactggggtcagggaaccctggtcaccgtctcgagc

SEQ ID NO: 788 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaatttgtatgagatgacttgggtccgccaggctccagggaagggtctagagtgggtctcatctattactagtgatggtgtttctacatactacgcagactccgtgaagggccggttcaccatctcccgcgacaattccaagaacacgctgtatctgcaaatgaacagcctgcgtgccgaggacaccgcggtatattactgtgcgaaagctggggtgatttttgactactggggtcagggaaccctggtcaccgtctcgagc

SEQ ID NO: 789 - DNA, 369 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgagaattatgctatgtcgtgggtccgccaggctccagggaagggtctagagtgggtctcaacgattgctccgctgggtgttccgacatactacgcagactccgtgaagggccggttcaccatctcccgcgacaattccaagaacacgctgtatctgcaaatgaacagcctgcgtgccgaggataccgcggtatattactgtgcgaaaaagaaggttggggcgtggctgcagtcgcggagttttgactactggggtcagggaaccctggtcaccgtctcgagc

SEQ ID NO: 790 - DNA, 360 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttatggattatgagatgcattgggtccgccaggctccagggaagggtctagagtgggtctcaacgattggtgcttctggtcattatacatactacgcagactccgtgaagggccggttcaccatctcccgcgacaattccaagaacacgctgtatctgcaaatgaacagcctgcgtgccgaggacaccgcggtatattactgtgcgaaatatcttgatatgctgctgtttgggtttgactactggggtcagggaaccctggtcaccgtctcgagc

SEQ ID NO: 791 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgctgagtatgagatgatgtgggcccgccaggctccagggaagggtctagagtgggtctcacgtattgctggtaatggttctcgtacatactacgcagactccgtgaagggccggttcaccatctcccgcgacaattccaagaacacgctgtatctgcaaatgaacagcctgcgtgccgaggacaccgcggtatattactgtgcgataatgctttctcattttgactactggggtcagggaaccctggtcaccgtctcgagc

SEQ ID NO: 792 - DNA, 363 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcaccttttataattatgatatgagttgggtccgccaggctccagggaagggtctagagtgggtctcaggtattgattcgatgggtcttgttacatactacgcagactccgtgaagggccggttcaccatctcccgcgacaattccaagaacacgctgtatctgcaaatgaacagcctgcgtgccgaggataccgcggtatattactgtgcgaaagggtctaatgcgagtgattgggttgtttttgactactggggtcagggaaccctggtcaccgtctcgagc

SEQ ID NO: 793 - DNA, 363 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgcgtcgtatcatatgacttgggtccgccaggctccagggaagggtctagagtgggtctcatcgattgcggatacgggtgatcgtacatactacgcagactccgtgaagggccggttcaccatctcccgcgacaattccaagaacacgctgtatctgcaaatgaacagcctgcgtgccgaggacactgcggtatattactgtgcgaaattgcgtgggatggctcgggtttgggggtttgactactggggtcagggaaccctggtcaccgtctcgagc

SEQ ID NO: 794 - DNA, 369 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttagttattatgatatgatgtgggtccgccaggctccagggaagggtctagagtggatctcatctatttcggatcgtggtcttcagacatactacgcagactccgtgaagggccggttcaccatctcccgcgacaattccaagaacacgctgtatctgcaaatgaacagcctgcgtgccgaggataccgcggtatattactgtgcgaaatttacggagattccgttggattggttggaggtgtttgactactggggtcagggaaccctggtcaccgtctcgagc

SEQ ID NO: 795 - DNA, 366 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgggagttataagatgttgtgggtccgccaggctccagggaagggtctagagtgggtctcatcgattactaattctggtactgagacatactacgcagactccgtgaagggccggttcaccatctcccgcgacaattccaagaacacgctgtatctgcaaatgaacagcctgcgtgccgaggacaccgcggtatattactgtgcgaaatcgatgtatccggatttggagattgtgcattttgactactggggtcagggaaccctggtcaccgtctcgagc

SEQ ID NO: 796 - DNA, 363 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgagacttatcgtatgagttgggtccgccaggctccagggaagggtctagagtgggtctcagctattgatcaggagggttctgctacatactacgcagactccgtgaagggccggttcaccatctcccgcgacaattccaagaacacgctgtatctgcaaatgaacagcctgcgtgccgaggataccgcggtatattactgtgcgaaaaatagtgggacgaggccggggcttcggtttgactactggggtcagggaaccctggtcaccgtctcgagc

SEQ ID NO: 797 - DNA, 363 bp, Artificial Sequence
  Description of Artificial Sequence: Synthetic polynucleotide
gaggtgcagctgttggagtctgggggaggcttggtacagcctggggggtccctgcgcctctcctgtgcagcctccggattcacctttagtagttatgatatgctttgggtccgccaggctccagggaagggtctagagtgggtctcacggattgatgcgagtggttattttacatactacgcagactccgtgaagggccggttcaccatctcccgcgacaattccaagaacacgctgtatctgcaaatgaacagcctgcgtgccgaggacaccgcggtatattactgtgcgcaattgttgaagctgtcgttgaatcctaattttgactactggggtcagggaaccctggtcaccgtctcgagc

SEQ ID NO: 798 - DNA, 360 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttagcagctatgccatgagctgggtccgccaggctccagggaagggtctagagtgggtctcatcgattcataatactggtttgtctacatactacgcagactccgtgaagggccggttcaccatctcccgcgacaattccaagaacacgctgtatctgcaaatgaacagcctgcgtgccgaggacaccgcggtatattactgtgcgaaagggactcagcatcgttttgttgtttttgactactggggtcagggaaccctggtcaccgtctcgagc

SEQ ID NO: 799 - DNA, 369 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgagggttatcctatgtcgtgggtccgccaggctccagggaagggtctagagtgggtctcaactattagtcctttgggtcctgatacatactacgcagactccgtgaagggccggttcaccatctcccgcgacaattccaagaacacgctgtatctgcaaatgaacagcctgcgtgccgaggataccgcggtatattactgtgcgaaactgttgatgggggagtatttgaattctaggacgtttgactactggggtcagggaaccctggtcaccgtctcgagc

SEQ ID NO: 800 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaatacgtatagtatgtcttgggtccgccaggctccagggaagggtctggagtgggtctcatggattgatgctgatggttgggttacatactacgcagactccgtgaagggccggttcaccatctcccgcgacaattccaagaacacgctgtatctgcaaatgaacagcctgcgtgccgaggacaccgcggtatattactgtgcgcaaactgggcatacgtttgactactggggtcagggaaccctggtcaccgtctcgagc

SEQ ID NO: 801 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttacggatggggagatgggttgggcccgccaggctccagggaagggtctagagtgggtctcaaggattgtggatcctggtgattctacatactacgcagactccgtgaagggccggttcaccatctcccgcgacaattccaagaacacgctgtatctgcaaatgaacagcctgcgtgccgaggacaccgcggtatattactgtgcgaaagcgggtgatcagtttgactactggggtcagggaaccctggtcaccgtctcgagc

SEQ ID NO: 802 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcctgagtatgagatgaagtgggtccgccaggctccagggaagggtctagagtgggtctcaactattactccgtcgggtggtcatacatactacgcagactccgtgaagggccggttcaccatctcccgcgacaattccaagaacacgctgtatctgcaaatgaacagcctgcgtgccgaggacgccgcggtatattactgtgcgatacctctttctagttttgactactggggtcggggaaccctggtcaccgtctcgagc

SEQ ID NO: 803 - DNA, 369 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcaccttttctaattatgtgatgatttgggtccgccaggctccagggaagggtctagagtgggtctcacttattaatggtgctggtgatatgacatactacgcagactccgtgaagggccggttcaccatctcccgcgacaattccaagaacacgctgtatctgcaaatgaacagcctgcgtgccgaggacaccgcggtatattactgtgcggaagggggtgcgcgttcgtttggggttccgcctaattttgactactggggtcagggaaccctggtcaccgtctcgagc

SEQ ID NO: 804 - DNA, 348 bp, Artificial Sequence; identical to SEQ ID NO: 801
  Description of Artificial Sequence: Synthetic polynucleotide

SEQ ID NO: 805 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgtagcctccggattcacctttacgctgtataatatgtcttgggtccgccaggctccagggaagggtctggagtgggtctcagttatttctagtaagggtgatagtacatactacgcagactccgtgaagggccggttcaccatctcccgcgacaattccaagaacacgctgtatctgcaaatgaacagcctgcgtgccgaggacaccgcggtatattactgtgcgcaaacgagtagtgtttttgactactggggtcagggaaccctggtcaccgtctcgagc

SEQ ID NO: 806 - DNA, 369 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgaggcgtattatatgagttgggtccgccaggctccagggaagggtctagagtgggtctcaggtattgttaataatggtttgttgacatactacgcagactccgtgaagggccggttcaccatctcccgcgacaattccaagaacatgctgtatctgcaaatgaacagcctgcgtgccgaggacaccgcggtatattactgtgcgaaatcggctgttcatccttcgtatagggcggagttgttcgactactggggtcagggaaccctggtcaccgtctcgagc

SEQ ID NO: 807 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttagttcgtatgagatggcgtgggtccgccaggctccagggaagggtctagagtgggtctcacgtattgagcctgatggtagtaatacatactacgcagactccgtgaagggccggttcaccatctcccgcgacaattccaagaacacgctgtatctgcaaatgaacagcctgcgtgccgaggacaccgcggtatattactgtgcgaaaggtccggataattttactatgtttgactactggggtcagggaaccctggtcaccgtctcgagc

SEQ ID NO: 808 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaataagtatatgatggggtgggtccgccaggctccagggaagggtctagagtgggtctcatctattgatagtcttggtcattatacatactacgcagactctgtgaagggccggttcaccatctcccgcgacaattccaagaacacgctgtatctgcaaatgaacagcctgcgtgccgaggacaccgcggtatattactgtgcggaagcggagtttccgtttgactactggggtcagggaaccctggtcaccgtctcgagc

SEQ ID NO: 809 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaagaggtatgagatgacgtgggtccgccaggctccagggaagggtctggagtgggtctcatctatttcgtcggatggttcttttacatactacgcagactccgtgaagggccggttcaccatctcccgcgacaattccaagaacacgctgtatctgcaaatgaacagcctgcgtgccgaggataccgcggtatattactgtgcggaaccgtttactgagtttgactactggggtcagggaaccctggtcaccgtctcgagc

SEQ ID NO: 810 - DNA, 348 bp, Artificial Sequence
  Description of Artificial Sequence: Synthetic polynucleotide
gaggtgcagctgttggagtctgggggaggcatggtacagcctggggggtccctgcgtctctcctgtgcagcctccggattcacctttaagaggtatgagatgatgtgggtccgccaggctccagggaagggtctggagtgggtctcatctatttcgtcggatggttcttttacatactacgcagactccgtgaagggccggttcaccatctcccgcgacaattccaagaacacgctgtatctgcaaatgaacagcctgcgtgccgaggataccgcggtatattactgtgcggaaccgtttactgagtttgactactggggtcagggaacccaggtcaccgtctcgagc

SEQ ID NO: 811 - DNA, 348 bp, Artificial Sequence
  Description of Artificial Sequence: Synthetic polynucleotide
gaggtgcagctgttggagtctgggggaggcatggtgcagcctggggggtccctgcgtctctcctgtgcagcctccggattcacctttaagaggtatgagatgatgtgggtccgccaggctccagggaagggtctggagtgggtctcatctatttcgtcggatggttcttttacatactacgcagactccgtgaagggccggttcaccatctcccgcgacaattccaagaacacgctgtatctgcaaatgaacagcctgcgtgccgaggataccgcggtatattactgtgcggaaccgtttactgagtttgactactggggtcagggaaccctggtcaccgtctcgagc

SEQ ID NO: 812 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaagaggtatgagatgatgtgggtccgcaaggctccagggaagggtctggagtgggtctcatctatttcgtcggatggttcttttacatactacgcagactccgtgaagggccggttcaccatctcccgcgacaattccgagaacacgctgtatctgcaaatgaacagcctgcgtgccgaggataccgcggtatattactgtgcggatccgtttactgagtttgactattggggtcagggtaccctggtcaccgtctcgagc

SEQ ID NO: 813 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaagaggtatgagatgatgtgggtccgccaggctccagggaagggtctggagtgggtctcatctatttcgtcggatggttcttttacatactacgcagactccgtgaagggccggttcaccgtctcccgcgacaattccaagaacacgctgtatctgcaaatgaacagcctgcgtgccgaggataccgcggtatattactgtgcggacccgtttactgagtttgactactggggtcagggaaccctggtcaccgtctcgagc

SEQ ID NO: 814 - DNA, 348 bp, Artificial Sequence
  Description of Artificial Sequence: Synthetic polynucleotide
gaggtgcagctgttggagtcggggggaggcttggtacagcctggggggtccctgcgtctctcgtgtgcagcctccggattcacctttaagaggtatgagatgatgtgggtccgccaggctccagggaagggtctggagtgggtctcatctatttcgtcggatggttcttttacatactacgcagactccgtgaagggccggttcaccatctcccgcgacaataccaagaacacgctgtatctacagatgaacagcctgcgtgccgaggataccgcggtatattactgtgcggacccgtttactgagcttgactactggggtcatggaaccctggtcaccgtctcgagc

SEQ ID NO: 815 - DNA, 348 bp, Artificial Sequence
  Description of Artificial Sequence: Synthetic polynucleotide
gaggtgcagctgttggagtctgggggaggcttggtacggcctggggggtccctgcgtctctcctgtgcagcctccggattcacctttaagaggtatgagatgatgtgggtccgccaggctccagggaagggtctggagtgggtctcatctatttcgtcggatggttcttttacatactacgcagactccgtgaagggccggttcaccatctcccgcgacaattccaagaacacgctgtatctgcaaatgaacagcctgcgtgccgaggataccgcggtatatttctgtgcagatccgtttactgagtttgactactggggtcagggaaccctggtcaccgtctcgagc

SEQ ID NO: 816 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcgcctttaagaggtatgagatgacatgggtccgccaggctccagggaagggtctggagtgggtctcatctatttcgtcggatggttcttttacatactacgcagactccgtgaagggccggttcaccatctcccgcgacaattccaagaacacgctgtatctgcatatgaacagcctgcgtgccgaggataccgcggtatattactgtgcggatccgtttactgagattgactactggggtcagggaaccctggtcaccgtctcgagc

SEQ ID NO: 817 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcccctttaagaggtatgagatgacgtgggtccgccaggctccagggaagggtctggagtgggtctcatctatttcgtcggatggttcttttacatactacgcagactccgtgaagggccggttcaccatctcccgcgacaattccaagaacacgctgtatctgcaaatgaacagcctgcgtgccgaggataccgcggtatattactgtgcggaaccgtttactgagtttgactaccgggctcagggaaccctggtcaccgtctcgagc

SEQ ID NO: 818 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaagaggtatgagatgtcgtgggtccgccaggctccagggaagggtctggagtgggtctcttctatttcgtcggatggttcttttacatactacgcagactccgtgaagggccggttcaccatctcccgcgacaattccaagaacacgctgtatctgcaaatgaacagcctgcgtgccgaggataccgcggtatattactgtgcggatccgtttactgagattgactactggggtcagggaacccaggtcaccgtctcgagc

SEQ ID NO: 819 - DNA, 348 bp, Artificial Sequence
  Description of Artificial Sequence: Synthetic polynucleotide
gaggtgcagctgttggagtctgggggaggcttggtacatcctggggggtccctgcgtctctcctgtgcagcttccggattcacctttaagaggtatgagatgatgtgggtccgccaggctccagggaagggtctggagtgggtctcatctatttcgtcggatggttcttttacatactacgcagactccgtgaagggccggttcaccatctcccgcgacaattccaagaacacgctgtatctgcaaatgaacagcctgcgtgacgaggataccgcggtatattactgtgcggaaccgtttactgagtttgactacgggggtcagggaaccctggtcaccgtctcgagc

SEQ ID NO: 820 - DNA, 348 bp, Artificial Sequence
  Description of Artificial Sequence: Synthetic polynucleotide
gaggtgcagctgttggagtctgggggaggctgggtacagcctggggggtccctgcgtctctcctgtgcagcctcaggattcacctttaagaggtatgagatgatgtgggtccgccaggctccagggaagggtctggagtgggtctcatctatttcgtcggatggttcttttacatactacgcagactccgtgaagggccggttcaccatctcccgcgacaattccaagaacacgctgtatctgcaaatgaacagcctgcgtgccgaggataccgcggtatattactgtgcggatccgtttactgagtttgactactggggtcagggaaccctggtcaccgtctcgagc

SEQ ID NO: 821 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaagaggtatgagatgatgtgggtccgccaggctccagggaagggtctggagtgggtctcatctatttcgtcggatggttcttttacatactacgcagactccgtgaagggccggttcaccatctcccgcgacaattccaagaacacgctgtatctgcaaatgaacagcctgcgtgccgaggataccgcggtatattactgtgcggaaccgtttactgagtttgactactggggtcatggaaccctggtcaccgtctcgagc

SEQ ID NO: 822 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaagaggtatgagatgacgtgggtccgccaggctccagggaagggtctggagtgggtctcatctatttcgtcggatggttcttttacatactacgcagactccgtgaagggccggttcaccatctcccgcgacaattccaagaacactctgtatctgcaaatgaacagcctgcgtgccgaggataccgcggtatattactgtgcggaaccgtttactgagattgactaccggggtcagggaaccctggtcaccgtctcgagc

SEQ ID NO: 823 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaagaagtatgagatgatgtgggtccgccaggctccagggaagggtctggagtgggtctcatctatttcgtcggatggttcttttacatactacgcagactccgtgaagggccggttcaccatctcccgcgacaattccaagaacacgctgtatctgcaaatgaacagcctgcgtgccgaggataccgcggtatattactgtgcggaaccgtttactgagtttgactactggggtcatggaaccctggtcaccgtctcgagc

SEQ ID NO: 824 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaacagctatgagatgatgtgggtccgccaggctccagggaagggtctagagtgggtctcatctatttcgtcggatggttcttttacatactacgcagactccgtgaagggccggttcaccatctcccgcgacaattccaagaacacgctgtatctgcaaatgaacagcctgcgtgccgaggataccgcggtatattactgtgcggaaccgtttactgagtttgactactggggtcatggaaccctggtcaccgtctcgagc

SEQ ID NO: 825 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaagaggtatgagatgatgtgggtccgccaggctccagggaagggtctggagtgggtctcatctatttcgtcggatggttcttttacatactacgcagactccgtgaagggccggttcaccatctcccgcgacaattccaagaacacgctgtatctgcaaatgaacagcctgcgtgccgaggataccgcggtatattactgtgcggatccatttactgagtttgactactggggtcagggaaccctggtcaccgtctcgagc

SEQ ID NO: 826 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaagaggtatgagatgatgtgggtccgccaggctccagggaagggtctggagtgggtctcatctatttcgtcggatggttcttttacatactacgcagactccgtgaagggccggttcaccatctcccgcgacaattccaagaacacgctgtatctgcaaatgaacagcctgcgtgccgaggacaccgcggtatattactgtgcggacccgttcacggagatggactactggggtcatggaaccctggtcaccgtctcgagc

SEQ ID NO: 827 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaagaggtatgagatgatgtgggtccgccaggctccagggaagggtctggagtgggtctcatctatttcgtcggatggttcttttacatactacgcagactccgtgaagggccggttcaccatctcccgcgacaattccaagaacacgctgtatctgcaaatgaacagcctgcgtgccgaggacaccgcggtatattactgtgcggacccgttcacggagttcgactactggggtcatggaaccctggtcaccgtctcgagc

SEQ ID NO: 828 - DNA, 348 bp, Artificial Sequence
  Description of Artificial Sequence: Synthetic polynucleotide
gaggtgcagctgttggagtctgggggaggcttggtacagcctggggggtccctgcgtctatcctgtgcagcctccggattcacctttaagaggtatgagatgatgtgggtccgccaggctccagggaagggtctggagtgggtctcatctatttcgtcggatggttcttttacatactacgcagactccgtgaagggccggttcaccatctcccgcgacaattccaagaacacgctgtatctgcaaatgaacagcctgcgtgccgaggataccgcggtatattactgtgcggagccgttcacggagttggactactggggtcatggaaccctggtcaccgtctcgagc

SEQ ID NO: 829 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaagaggtatgagatgatgtgggtccgccaggccccagggaagggtctggagtgggtctcatcgatttcgtccgacggttccttcacgtactacgccgagtcggtcaagggccggttcaccatctcccgcgacaattccaagaacacgctgtatctgcaaatgaacagcctgcgtgccgaggataccgcggtatattactgtgcggaaccgtttactgagtttgactactggggtcatggaaccctggtcaccgtctcgagc

SEQ ID NO: 830 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaacacgtatgagatgcagtgggtccgccaggctccagggaagggtctggagtgggtctcatctatttcgtcggatggttcttttacatactacgcagactccgtgaagggccggttcaccatctcccgcgacaattccaagaacacgctgtatctgcaaatgaacagcctgcgtgccgaggataccgcggtatattactgtgcggaaccgtttactgagtttgactactggggtcatggaaccctggtcaccgtctcgagc

SEQ ID NO: 831 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaacaagtatgagatgatgtgggcccgccaggctccagggaagggtctggagtgggtctcatctatttcgtcggatggttcttttacatactacgcagactccgtgaagggccggttcaccatctcccgcgacaattccaggaacacgctgtatctgcaaatgaacagcctgcgtgccgaggataccgcggtatattactgtgcggaaccgtttactgagtttgactactggggtcatggaaccctggtcaccgtctcgagc

SEQ ID NO: 832 - DNA, 348 bp, Artificial Sequence
  Description of Artificial Sequence: Synthetic polynucleotide
gaggtgcagctgtcggagtctgggggaggcttggtacagcctggggggtccctgcgtctctcctgtgcagcctccggattcacctttaagaggtatgagatgatgtgggtccgccaggctccagggaagggtctggagtgggtctcatctatttcgtcggatggttcttttacatactacgcagactccgtgaagggccggttcaccatctcccgcgacaattccaagaatacgctgtatctgcaaatgaacagcctgcgtgccgaggataccgcggtatattactgtgcggatccgtttactgagtttgactactggggtcagggaaccctggtcaccgtctcgagc

SEQ ID NO: 833 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaagaggtatgagatgatgtgggtccgccagactccagggaagggtctggagtgggtctcatctatttcgtcggatggttcttttacatactacgcagactccgtgaaggggcggttcaccatctcccgcgacaattccaagaacacgctgtatctgcaaatgaacagcctgcgtgccgaggataccgcagtatattactgtgcggaaccgtttactgagtttgactactggggtcagggaaccctggtcaccgtctcaagc

SEQ ID NO: 834 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaagaggtatgagatgatgtgggtccgccaggctccagggaagggtctggagtgggtctcatctatttcgtcggatggttcttttacatactacgcagactccgtgaagggccggttcaccatctcccgcgacaattccaagaacacgctgtatctggaaatgaacagcatgcgtgccgaggataccgcggtatattactgtgcggaaccgtttactgagtttgacaactggggtcagggaaccctcgtcaccgtctcgagc

SEQ ID NO: 835 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaagaggtatgagatgatgtgggtccgccaggctccagggaagggtctggagtgggtctcatctatttcgtcggatggttcttttacatactacgcagactccgtgaagggccggttcaccatctcccgcgacaattccaagaacacgctgtatctgcaaatgaacagcctgcgtgccgaggataccgcggtatattactgtgcagaaccgtttactgagtttgactactggggtcagggaacccaggtcaccgtctcgagc

SEQ ID NO: 836 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcaactttaagaggtatgagatgacgtgggtccgccaggctccagggaagggtctggagtgggtctcatctatttcgtcggatggttcttttacatactacgcagactccgtgaagggccggttcaccatctcccgcgacaattccaagaacacgctgtatctgcaaatgaacagcctgcgtgccgaggataccgcggtatattactgtgcagacccgtttactgagtttgactactggggtcagggaaccctggtcaccgtctcgagc

SEQ ID NO: 837 - DNA, 348 bp, Artificial Sequence
  Description of Artificial Sequence: Synthetic polynucleotide
gaggtgcagctgttggagtctgggggagacttggtacagcctggggggtccctgcgtctctcctgtgcagcctccggattcacctttaagaggtatgagatgatgtgggtccgccaggctccagggaagggtctggagtgggtctcatctatttcgtcggatggttcttttacatactacgcagactccgtgaagggccggttcaccatctcacgcgacaattccaagaacacgctgtatctgcaaatgaacagcctgcgtgccgaggataccgcggtatattactgtgcggaaccgtttactgagtttgactacaggggtcagggaaccctggtcaccgtctcgagc

SEQ ID NO: 838 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaagaggtatgagatgtcgtgggtccgccaggctccagggaagggtctggagtgggtctcatctatttcgtcggatggttcttttacatactacgcagactccgtgaagggccggttcaccatctcccgcgacaattccaagaacacgctgtatctgcaaatgaacagcctgcgtgccgaggataccgcggtatattactgtgcggaaccgtttactgagtttgactactggggtcggggaaccctggtcaccgtctcgagc

SEQ ID NO: 839 - DNA, 372 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgaggcgtatcctatgtcgtgggtccgccaggctccagggaagggtctagagtgggtctcaagtatttcccctcttggtttgtggacatactacgcagactccgtgaagggccggttcaccatctcccgcgacaattccaagaacacgctgtatctgcaaatgaacagcctgcgtgccgaggacaccgcggtatattactgtgcgaaacttagtgctggggcggagactcatgtttatcggctttttgactactggggtcagggaaccctggtcaccgtctcgagc

SEQ ID NO: 840 - DNA, 366 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttggtaattatgagatgatgtgggtccgccaggctccagggaagggtctagagtgggtctcatctattggggtgttgggtcatacgacatactacgcagactccgtgaagggccggttcaccatctcccgcgacaattccaagaacacgctgtatctgcaaatgaacagcctgcgtgccgaggataccgcggtatattactgtgcgaaacttatgtcgttgaggacgtttgagaatctttttgactactggggtcagggaaccctggtcaccgtctcgagc

SEQ ID NO: 841 - DNA, 363 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttacgaagtatcctatggcttgggtccgccaggctccagggaagggtctagagtgggtctcaggtattgatgctaatggtaataggacatactacgcagactccgtgaagggccggttcaccatctcccgcgacaattccaagaacacgctgtatctgcaaatgaacagcctgcgtgccgaggacaccgcggtatattactgtgcggaagggacttggcgtaggcattttgcgatttttgactactggggtcagggaaccctggtcaccgtctcgagc

SEQ ID NO: 842 - DNA, 369 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgatctgtatgatatgatgtgggtccgccaggctccagggaagggtctagagtgggtctcatctatttctgatctgggtacgcttacatactacgcagactccgtgaagggccggttcaccatctcccgcgacaattccaagaacacgctgtatctgcaaatgaacagcctgcgtgccgaggacaccgcggtatattactgtgcgaaaaatggttttagggttacgagtaatgatcgtaggtttgactactggggtcagggaaccctggtcaccgtctcgagc

SEQ ID NO: 843 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttactggtggggatatgtggtgggtccgccaggctccagggaagggtctagagtgggtctcaatgattgagggtggtggtgtgactacatactacgcagactccgtgaagggccggttcaccatctcccgcgacaattccaagaacacgctgtatctgcaaatgaacagcctgcgtgccgaggacaccgcggtatattactgtgcggaacttgatcttcggacgggtcagtttgactactggggtcagggaaccctggtcaccgtctcgagc

SEQ ID NO: 844 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcaccttttcggcttatactatgggttgggtccgccaggctccagggaagggtctggagtgggtctcacttattggggatcgtggttcttggacatactacgcagactccgtgaagggccggttcaccatctcccgcgacaattccaagaacacgctgtatctgcaaatgaacagcctgcgtgccgaggacaccgcggtatattactgtgcggaaccgtcggatcctactaagtttgactactggggtcagggaaccctggtcaccgtctcgagc

SEQ ID NO: 845 - DNA, 354 bp, Artificial Sequence
  Description of Artificial Sequence: Synthetic polynucleotide
gaggtgcagctgttggagtctgggggaggcttggtacagcctggggggtccctgcatctctcctgtgcagcctccggattcaccttttcggcttatactatgggttgggtccgccaggctccagggaagggtctggagtgggtctcacttattggggatcgtggttcttggacatactacgcagactccgtgaagggccggttcaccatctcccgcgacaattccaagaacacgctgtatctgcaaatgaacagcctgcgtgccgaggacaccgcggtatatttctgtgcggatccgtcggatcctactaagtttgactactggggtcagggaaccctggtcaccgtctcgagc

SEQ ID NO: 846 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcaccttttcggcttatactatgggttgggtccgccaggctccagggaagggtctggagtgggtctcacttattggggatcgtggttcttggacatactacgcagactccgtgaagggccggttcaccatctcccgtgacaattccaagaacacgctgtatctgcaaatgaacagcctgcgtgccgaggacaccgcggtatattactgtgcggatccgtcggatcctactaagtttgactactggggtcagggaaccctggtcaccgtctcgagc

SEQ ID NO: 847 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcaccttttcggcttatactatgggttgggtccgccaggctccagggaagggtctggagtgggtctcacttattggggatcgtggttcttggacatactacgcagactccgtgaagggccggttcaccatctcccgcgacaattccaagaacacgctgtatctgcaaatgagcagcctgcgtgccgaggacaccgcggtatattactgtgcggatccgtcggatcctactaagtttgactactggggtcagggaaccctggtcaccgtctcgagc

SEQ ID NO: 848 - DNA, 354 bp, Artificial Sequence
  Description of Artificial Sequence: Synthetic polynucleotide
gaggtgcagctgttggagtctgggggtggcttggtacagcctggggggtccctgcgtctctcctgtgcagcctccggattcaccttcccggcttatactatgggttgggtccgccaggctccagggaagggtctggagtgggtctcacttattggggatcgtggttcttggacatactacgcagactccgtgaagggccggttcaccatctcccgcgacgattccaagaacacgctgtatctgcaaatgaacagcctgcgtgtcgaggacaccgcggtatattactgtgcggaaccgtcggatcctactatgtttgtctactggggtcagggaacccttgtcaccgtctcgagc

SEQ ID NO: 849 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcaccttttcggcttatactatgggctgggtccgccaggctccagggaagggtctggagtgggtctctcttattggggatcgtggttcttggacatactacgcagactccgtgaagggccggttcaccatctcccgcgacaattccaagaacacgctgtatctgcaaatgaacagcctgcgtgccgaggacaccgcggtatattactgtgcggaaccgtcggatcctactatgtttgtctactggggtcagggaaccctggtcaccgtctcgagc

SEQ ID NO: 850 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcatccggattcaccttttcggcttatactatgggttgggtccgccaggctccagggaagggtctggagtgggtctcacttattggggatcgtggttcttggacatactacgcagactccgtgaagggccggttcaccatctcccgtgacaattccaagaacacgctgtatctgcaaatgaacagcctgcgtgccgaggacaccgcggtatattactgtgcggatccgtcagatcctactatgtttgactactggggtcagggaaccctggtcaccgtctcgagc

SEQ ID NO: 851 - DNA, 354 bp, Artificial Sequence
  Description of Artificial Sequence: Synthetic polynucleotide
gaggtgcagctgttggagtctggggggggcatggtacagcctggggggtccctgcgtctctcctgtgcagcctccggattcaccttttcggcttatactatgggttgggtccgccaggctccagggaagggtctggagtgggtctcacttattggggatcgtggttcttggacatactacgcagactccgtgaagggccggttcaccatctcccgcgacaattccaagaacacgctgtatctgcaaatgaacagcatgcgtgccgaggacaccgcggtatattactgtgcggatccgtcggatcctactaagtttgactactggggtcagggaaccctggtcaccgtctcgagc

SEQ ID NO: 852 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcaccttttcggcttatactatgggttgggtccgccaggctccagggaagggtctggagtgggtcacacttattggggatcgtggttcttggacatactacgcagactccgtgaagggccggttcaccatctcccgcgacaattccaagaacacgctgtatctgcaaatgaacagcctgcgtgccgaggacaccgcggtatattactgtgcggaaccgtcggatcctactatgtttgactactggggtcagggaaccctggtcaccgtctcgagc

SEQ ID NO: 853 - DNA, 354 bp, Artificial Sequence
  Description of Artificial Sequence: Synthetic polynucleotide
gaggtgcagctgttggagtctgggggaggcttggtgcagcctggggggtccctgcgtctctcctgtgcagcctccggattcacctttacggcttatactatgggttgggtccgccaggctccagggaagggtctggagtgggtctcacttattggggatcgtggttcttggacatactacgcagactccgtgaagggccggttcaccatctcccgcgacaattccaagaacacactgtatctgcaaatgaacagcctgcgtgccgaggacaccgcggtatattactgcgcggaaccgtcggatcctactaagttagactactggggtcagggaaccctggtcaccgtctcgagc

SEQ ID NO: 854 - DNA, 354 bp, Artificial Sequence
  Description of Artificial Sequence: Synthetic polynucleotide
gaggtgcagctgtcggagtctgggggaggcttggtacagcctggggggtccctgcgtctcacctgtgcagcctccggattcaccttttcggcttatactatgggttgggtccgccaggctccagggaagggtctggagtgggtctcacttattggggatcgtggttcttggacatactacgcagactccgtgaagggccggttcaccatctcccgcgacaattccaagaacacgctgtatctgcaaatgaacagcctgcgtgccgaggacaccgcggtatattactgtgcggatccgtcggatcctactaagtttgtctactggggtcagggaaccctggtcaccgtctcgagc

SEQ ID NO: 855 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcaccttttcggcttatactatgggttgggtccgccaggctccagggaagggtctggagtgggtctcacttattggggatcgtggttcttggacatactacgcagactccgtgaagggccggttcaccatctcccgcgacaattccaagaacacgctgtatctgcaaatgaacagcctgcgtgccgaggacaccgcggtatattactgtgcagatccgtcggatcctactaagtttgtctactggggtcagggaaccctggtcaccgtctcgagc

SEQ ID NO: 856 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcaccttttcggcttatactatgggttgggtccgccaggctccagggaagggtctggagtgggtctcacttattggggatcgtggttcttggacatactacgcagactccgtgaagggccggttcaccatctcccgcgacaattccaagaacacgctgtatctgcaaatgaacagcctgcgtgccgaggacaccgcggtatattactgcgcggaaccgtcggatcctactaagtttgtctactggggtcagggaaccccggtcaccgtctcgagc

SEQ ID NO: 857 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcaccttttcggcttatactatgggttgggtccgccaggctccagggaagggtctggagtgggtctcgcttattggggatcgtggttcttggacatactacgcagactccgtgaagggccggttcaccatctcccgcgacaattccaggaacatgctgtatctgcaaatgaaaagcctgcgtgccgaggacaccgcggtatattactgcgcggatccgtcggatcctactaagtttgtctactggggtcaaggaacccaggtcaccgtctcgagc

SEQ ID NO: 858 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcaccttttcggcttatactatgggttgggtccgccaggctccagggaagggtctggagtgggtctcacttattggggatcgtggttcttggacatactacgcagactccgtgaagggccggttcaccatcttccgcgacaattccaagaacacgctgtatctgcaaatgaacagcctgcgtgccgaggacaccgcggtatattactgtgcggatccgtcggatcctactaagtttgtctactggggtcagggaaccctggtcaccgtctcgagc

SEQ ID NO: 859 - DNA, 354 bp, Artificial Sequence
  Description of Artificial Sequence: Synthetic polynucleotide
gaggtgcagctgttggagtctgggggaggcttgttacagcctggggggtccctgcgtctctcctgtgcagcctccggattcaccttttcggattatactatgggttgggtccgccaggctccagggaagggtctggagtgggtctcacttattggggatcgtggttcttggacatactacgcagactccgtgaagggccggttcaccatctcccgcgacaattccaagaacacgctgtatctgcaaatgaacagcctgcgtgccgaggacaccgcggtatattactgtgcggaaccgtcggatcctactaagttcgactactggggtcggggaaccctggtcaccgtctcgagc

SEQ ID NO: 860 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcaccttttcggcttatactatgggttgggtccgccaggctccagggaagggtctggagtgggtctcacttattggggatcgtggttcttggacatactacgcagactccgtgaagggccggttcaccatctcacgcgacaattccaagaacacgctgtatctgcaaatgaacagcctgcgtgccgaggacaccgcggtatattactgtgcggaaccgtccgatcctactaagtttgtctactggggtcagggaaccctggtcaccgtctcgagc

SEQ ID NO: 861 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcaccttttcggcttatactatgggttgggtccgccaggctccagggaagggtctggagtgggtctcacttattggggatcgtggtacttggacatattacgcagaccccgtgaagggccggttcaccatctcccgcgacaattccaagaacacactgtatctgcaaatgaacagcctgcgtgccgaggacactgcggtatattattgtgcggatccgtcggatcctactaagtttgactactggggtcagggaaccctggtcaccgtctcgagc

SEQ ID NO: 862 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcaccttttcggcttatactatgggttgggtccgccaggctccagggaagggtctggagtgggtctcacttattggggatcgtggttcttggacatactacgcagactccgtgaagggccggttcaccgtctcccgcgacaattccaagaacacgctgtatctgcaaatgaacagcctgcgtgccgaggacaccgcggtatattactgtgcggaaccgtcggatcctactaagtttgactactggggtcagggaaccctggtcaccgtctcgagc

SEQ ID NO: 863 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcaccttttcggcttatactatgggttgggtccgccaggctccagggatgggtctggagtgggtctcacttattggggatcgtggttcttggacatactacgcagactccgtgaagggccggttcaccatctcccgcgacaattccaagaacacgctgtatctgcaaatgaacagcctgcgtgccgaggacaccgcggtatattactgtgcggaaccgtcggatcctactaagtttgactactggggtcagggaaccctggtcaccgtctcgagc

SEQ ID NO: 864 - DNA, 348 bp, Artificial Sequence
  Description of Artificial Sequence: Synthetic polynucleotide
gaggtgcagctgttggagtctgggggaggcttggtacagcccggggggtccctgcgtctctcctgtgcagcctccggattcacctttgataattataagatgtattgggtccgccaggctccagggaagggtctggagtgggtctcaagtatttcggagataggtaatctgacatactacgcagactccgtgaagggccggttcaccatctcccgcgacaattccaagaacacgctgtatctgcaaatgaacagcctgcgtgccgaggacaccgcggtatattactgtgcgatagctctgacgcgttttgactactggggtcagggaaccctggtcaccgtctcgagc

SEQ ID NO: 865 - DNA, 366 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgcgagttatcgtatgtattgggtccgccaggctccagggaagggtctggagtgggtctcatatattgatccgccgggtagtcgtacatactacgcagactccgtgaagggccggttcaccatctcccgcgacaattccaagaacacgctgtatctgcaaatgaacagcctgcgtgccgaggacaccgcggtatattactgtgcgaaaagtttgaatttgtcgtttccttatattaattttgactactggggtcagggaaccctggtcaccgtctcgagc

SEQ ID NO: 866 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgagcggtatgagatgctgtgggtccgccaggctccagggaagggtctagagtgggtctcacgtatttctcattcgggtcggacgacatactacgcagactccgtgaagggccggttcaccatctcccgcgacaattccaagaacacgctgtatctgcaaatgaacagcctgcgtgccgaggacaccgcggtatattactgtgcgcaattggatggtccgtttgactactggggtcagggaaccctggtcaccgtctcgagc

SEQ ID NO: 867 - DNA, 366 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaagaggtattatatggattgggtccgccaggctccagggaagggtctagagtgggtctcaaggattaatcataatggttctgttacatactacgcagactccgtgaagggccggttcaccatctcccgcgacaattccaagaacacgctgtatctgcaaatgaacagcctgcgtgccgaggataccgcggtatattactgtgcgaaaatgccgcagggtacttctgattggtattattttgactactggggtcagggaaccctggtcaccgtctcgagc

SEQ ID NO: 868 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcaccttttctaagtatgatatgtcttgggtccgccaggctccagggaagggtctagagtgggtctcaactattctggaggatggtctgactacatactacgcagactccgtgaagggccggttcaccatctcccgcgacaattccaagaacacgctgtatctgcaaatgaacagcctgcgtgccgaggacaccgcggtatattactgtgcgaaaccggggcgtttgtttgactactggggtcagggaaccctggtcaccgtctcgagc

SEQ ID NO: 869 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcaccttttcggattatcctatgacgtgggtccgccaggctccagggaagggtctggagtgggtctcaactattctgtctccgggtacggagacatactacgcagactccgtgaagggccggttcaccatctcccgcgacaattccaagaacacgctgtatctgcaaatgaacagcctgcgtgccgaggacaccgcggtatattactgtgcgaaagctgagaaggattttgactactggggtcagggaaccctggtcaccgtctcgagc

SEQ ID NO: 870 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgagggtggtgagatgggttgggtccgccaggctccagggaagggtctagagtgggtctcaatgattccgatggatggtagtgcgacatactacgcagactccgtgaagggccggttcaccatctcccgcgacaattccaagaacacgctgtatctgcaaatgaacagcctgcgtgccgaggacaccgcggtatattactgtgcgaaagcgggtgaggtgtttgactactggggtcagggaaccctggtcaccgtctcgagc

SEQ ID NO: 871 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttagggagtatcatatgaagtgggcccgccaggctccagggaagggtctagagtgggtctcagggattagtagggatggtatgaatacatactacgcagactccgtgaagggccggttcaccatctcccgcgacaattccaagaacacgctgtatctgcaaatgaacagcctgcgtgccgaggacaccgcggtatattactgtgcgatacagcttgctttgtttgactactggggtcagggaaccctggtcaccgtctcgagc

SEQ ID NO: 872 - DNA, 363 bp, Artificial Sequence
  Description of Artificial Sequence: Synthetic polynucleotide
gaggtgcagctgttggagtctgggggaggcttggtacagcctggggggtccctgcgcctctcctgtgcagcctccggattcacctttcgtgattatgagatgctttgggcccgccaggctccagggaagggtctagagtgggtctcaggtattcttccgtcgggtggggctacatactacgcagactccgtgaagggccggttcaccatctcccgcgacaattccaagaacacgctgtatctgcaaatgaacagcctgcgtgccgaggacaccgcggtatattactgtgcgaaagctggttcggggaatgggcctattctttttgactactggggtcagggaaccctggtcaccgtctcgagc

SEQ ID NO: 873 - DNA, 366 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaaggagcatgatatgttttgggtccgccaggctccagggaagggtctagagtgggtctcagggattggggctgagggtgtttggacatactacgcagactccgtgaagggccggttcaccatctcccgcgacaattccaagaacacgctgtatctgcaaatgaacagcctgcgtgccgaggacaccgcggtatattactgtgcggaaccgacgatgtctaatggttctcagtcgcgttttgactactggggtcagggaaccctggtcaccgtctcgagc

SEQ ID NO: 874 - DNA, 369 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgataatactgagatggcttgggtccgccaggctccagggaagggtctagagtgggtctcaggtattattgaggatggtaatcgtacatactacgcagactccgtgaagggccggttcaccatctcccgcgacaattccaagaacacgctgtatctgcaaatgaacagcctgcgtgccgaggacaccgcggtatattactgtgcgaaaattcgtaatctgcattgggatgtggggaggcagtttgactactggggtcagggaaccctggtcaccgtctcgagc

SEQ ID NO: 875 - DNA, 369 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgataatactgagatggcttgggtccgccaggctccagggaagggtctagagtgggtttcaggtattactgaggatggtaatcgtacatactacgcagactccgtgaagggccggttcaccatctcccgcgacaattccaagaacacgctgtatctgcaaatgaacagcctgcgtgccgaggacaccgcggtatattactgtgcgaaaattcgtaatctgcattgggatgtggggaggcagtttgactactggggtcagggaaccctggtcaccgtctcgagc

SEQ ID NO: 876 - DNA, 369 bp, Artificial Sequence
  Description of Artificial Sequence: Synthetic polynucleotide
gaggtgcagctgttggagtctgggggaggcttggtacagcctggggggtcccttcgtctctcctgtgcagcctccggattcacctttgataatactgagatggcttgggtccgccaggctccagggaagggtctagagtgggtctcaggtattactgaggatggtaatcgtacatactacgcagactccgtgaagggccggttcaccatctcccgcgacaattccaagaacacgctgtatctgcaaatgaacaacctgcgtgccgaagacaccgcggtatattactgtgcgaaaattcgtaatctgcattgggatgtggggaggcagtttgactactggggtcagggaaccctggtcaccgtctcgagc

SEQ ID NO: 877 - DNA, 369 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgataatactgagatggcttggatccgccaggctccagggaagggtctagagtgggtctcaggtattactgaggatggtaatcgtacatactacgcagactccgtgaagggccggttcaccatctcccgcgacaatttcaagaacacgctgtatctgcagatgaacagcctgcgtgccgaggacaccgcggtatattactgtgcgaaaattcgtaatctgcattgggatgtggggaggcagtttgactactggggtcagggaaccctggtcaccgtctcgagc

SEQ ID NO: 878 - DNA, 369 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgataatactgagatggcttgggtccgccaggctccagggaagggtctagagtgggtctcaggtattactgaggatggtaatcgtacatactacgcagattccgtgaagggccggttcaccatctcccgcgacaattccatgaacacgctgtatctgcaaatgaacagcctgcgtgccgaggacaccgcggtatattactgtgcgaaaattcgtaatctgcattgggatgtggggaggcagtttgtctactggggtcagggaaccctggtcaccgtctcgagc

SEQ ID NO: 879 - DNA, 369 bp, Artificial Sequence
  Description of Artificial Sequence: Synthetic polynucleotide
gaggtgcagctgttggagtctgggggaggcttggtacagcctggggggtccttgcgtctctcctgtgcagcctccggattcacctttgataacactgagatggcttggatccgccaggctccagggaagggtctagagtgggtctcaggtattattgaggatggtaatcgtacatactacgcagactccgtgaagggccggttcaccatctcccgcgacaattccaagaacacgctgtatctgcaaatgaacagcctgcgtgccgaggacaccgcggtatattactgtgcgaaaattcgtaatctgcattgggatgtggggaggcagtttgactactggggtcagggaaccctggtcaccgtctcgagc

SEQ ID NO: 880 - DNA, 369 bp, Artificial Sequence
  Description of Artificial Sequence: Synthetic polynucleotide
gaggtgcagctgttggagtctgggggaggcttggtacagcctggggggtccctgcgtctctcctgtgcagcctccgggttcacctttgataatactgagatggcttggatccgccaggctccagggaagggtctagagtgggtctcaggtattactgaggatggtaatcgtacatactacgcagactccgtgaagggccggttcaccatctcccgcgacaattccaagaacacgctgtatctgcaaatgaacagcctgcgtgctgaggacaccgcggtatattactgtgcgaaaattcgtaatctgcattgggatgtggggaggcagtttgactactggggtcagggaaccctggtcaccgtctcgagc

SEQ ID NO: 881 - DNA, 369 bp, Artificial Sequence
  Description of Artificial Sequence: Synthetic polynucleotide
gaggtgcagctgttggagtctgggggaggcttggtacagccaggggggtccctgcgtctctcctgtgcagcctctggattcacctttgataatactgagatggcttggatccgccaggctccagggaagggtctagagtgggtctcaggtattactgaggatggtaatcgtacatactacgcagactccgtgaagggccggttcaccatctcccgcgacaattccaagaacgcgctgtatctgcaaatgaacagcctgcgtgccgaggacaccgcggtatattactgtgcgaaaattcgtaatctgcattgggatgtggggaggcagtttgactactggggtctgggaaccctggtcaccgtctcgagc

SEQ ID NO: 882 - DNA, 369 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgataatactgagatggcttgggtccgccaggctccagggaagggtctagagtgggtctcaggtattactgaggatggtaatcgtacatactacgcagactccgtgaagggccggttcaccatctcccgcgacaataccaagaacacgctgtatctgcaaatgaacagcctgcgtgccgaggacaccgcggtatattactgtgcgaaaattcgtaatctgcattgggatgtggggaggcagtttgtctactggggtcagggaaccctggtcaccgtctcgagc

SEQ ID NO: 883 - DNA, 369 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgataatactgagatggcctggatccgccaggctccagggaagggtctagagtgggtctcaggtattattgaggatggtaatcgtacatactacgcagactccgtgaagggccggttcaccatctcccgcgacaattccaagaacaggctgtatctgcaaatgaacagcctgcgtgccgaggacaccgcggtatattactgtgcgaaaattcgtaatctgcattgggatgtggggaggcagtttgactactggggtcagggcaccctggtcaccgtttcgagc

SEQ ID NO: 884 - DNA, 369 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgataatactgagatggcttgggtccgccaggctccagggaagggtctagagtgggtctcaggtattactgaggatggtaatcgtacatactacgcagactccgtgaagggccggttcaccatctcccgcgacaattccaagaacacgctgtatctgcaaatgaacagcctgcgtgccgaggacaccgcggtatatcactgtgcgaaaattcgtaatctgcattgggatgtggggaggcagtttgactactggggtcagggaaccctcgtcaccgtctcgagc

SEQ ID NO: 885 - DNA, 369 bp, Artificial Sequence
  Description of Artificial Sequence: Synthetic polynucleotide
gaggtgcagctgttggagtctgggggaggcttggtacagcctgaggggtccctgcgtctctcctgtgcagcctccggattcacctttgataatactgagatggcttgggtccgccaggctccagggaagggtctagagtgggtctcaggtattattgaggatggtaatcgtacatactacgcagactccgtgaagggccggttcaccatctcccgcgacaattccaagaacacgctgtatctgcaaatgaacagcctgcgtgccgaggacaccgcggtatattactgtgcgaaaattcgtaatctgcattgggatgtggggaggcagtttgactactggggtcagggaaccctggtcaccgtctcgagc

SEQ ID NO: 886 - DNA, 369 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgataatactgagatggcttgggtccgccaggctccagggaagggtctagagtgggtctcaggtattagtgaggatggtaatcgtacatactacgcagactccgtgaagggccggttcaccatctcccgcgacaattccaagaacacgctgtatctgcaaatgaacagcctgcgtgcagaggactccgcggtatattactgtgcgaaaattcgtaatctgcattgggatgtggggaggcagtttgtctactggggtcagggaaccctggtcaccgtctcgagc

SEQ ID NO: 887 - DNA, 369 bp, Artificial Sequence
  Description of Artificial Sequence: Synthetic polynucleotide
gaggtgcagctgttggagtctgggggaggcttggtagagcctggggggtccctgcgtctctcctgtgcagcctccggattcacctttgataatactgagatggcttgggtccgccaggctcctgggaagggtctcgagtgggtctcaggtattactgaggatggtaatcgtacatactacgcagactccgtgaagggccggttcaccatctcccgcgacaattccaagaacacgctgtatctgcaaatgagcagcctgcgtgccgaggacaccgcggtatattactgtgcgaaaattcgtaatctgcattgggatgtggggaggcagtttgactactggggtcagggaaccctggtcaccgtctcgagc

SEQ ID NO: 888 - DNA, 369 bp, Artificial Sequence
  Description of Artificial Sequence: Synthetic polynucleotide
gaggtgcagctgttggagtctgggggaggcctggtacagcctggggggtccctgcgtctctcctgtgcagcctccggattcacctttgataatactgagatggcttgggtccgccaggctccagggaagggtctagagtgggtctcaggtattagtgaggatggtaatcgtacatactacgcagactccgtgaagggccggttcaccatctcccgcgacaattccaagaacacgctgtatctgcaaatgaacagcctgcgtgccgaggacaccgcggtatatcactgtgcgaaaattcgtaatctgcattgggatgtggggaggcagtttgactactggggtcagggaaccctggtcaccgtctcgagc

SEQ ID NO: 889 - DNA, 369 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgataatactgagatggcttgggtccgccaggctccagggaagggtctagagtgggtctcaggtattactgaggatggtaatcgtacatactacgctgactccgtgaagggccggttcatcatctcccgcgacaattccaagaacacgctgaatctgcaaatgaacagcctgcgtgccgaggacaccgcggtatattactgtgcgaaaattcgtaatctgcattgggatgtggggaggcagtttgactactggggtcagggaaccctggtcaccgtctcgagc

SEQ ID NO: 890 - DNA, 369 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgataatactgagatggcttggatccgccaggctccagggaggggtctagagtgggtctcaggtgttactgaggatggtaatcgtacatactacgcagactccgtgaagggccggttcaccatctcccgcgacaattccaagaacacgctgtatctgcaaatgaacagcctgcgtgccgaggacaccgcggtatattactgtgcgaaaattcgtaatctgcattgggatgtggggaggcaatttgactactggggtcagggaaccctggtcaccgtctcgagc

SEQ ID NO: 891 - DNA, 369 bp, Artificial Sequence
  Description of Artificial Sequence: Synthetic polynucleotide
gaggtgcagctgttggagtcagggggaggcttggtacagcctggggggtccctgcgtctctcctgtgaagcctccggattcacctttgataatactgagatggcttggatccgccaggctccagggaagggtctagagtgggtctcaggtattattgaggatggtaatcgtacatactacgcagactccgtgaagggccggttcaccatctcccgcgacaataccaagaacacgctgtatctgcaaatgaacagcctgcgtgccgaggacaccgcggtatattattgtgcgaaaattcgtaatctgcattgggatgtggggaggcagtttgactactggggtcagggaaccctggtcaccgtctcgagt

SEQ ID NO: 892 - DNA, 369 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgataatactgagatggcttggatccgccaggctccagggaagggtctagagtgggtctcaggtattactgaggatggtgatcgtacatactacgcagactccgtgaagggccggttcaccatctcccgcgacaattccaagagctcgctgtatctgcaaatgaacagcctgcgtgccgaggacaccgcggtatattactgtgcgaaaattcgtaatctgcattgggatgtggggaggcagtttgactactggggtcagggaaccctggtcaccgtctccagc

SEQ ID NO: 893 - DNA, 369 bp, Artificial Sequence
  Description of Artificial Sequence: Synthetic polynucleotide
gaggtgcagctgttggagtctgggggaggctcggtacagcctggggggtccctgcgtctctcctgtgcagcctccggattcacctttgataatactgagatggcttgggtccgccaggctccagggaagggtctagagtgggtctcaggtattactgaggatggtaatcgtacatactacgcagactccgtgaagggccggttcaccatctcccgcgacaattccaagaacactctgtatctgcaaatgaacagcctgcgtgccgaggacaccgcggtatattactgtgcgaaaattcgtaatctgcattgggatgtggggaggcagtttgtctactggggtcagggaaccctggtcaccgtctcgagc

SEQ ID NO: 894 - DNA, 369 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgggtcggctgagatggggtgggtccgccaggctccagggaagggtctagagtgggtctcaggtatttcgaggcctggtcaggttacatactacgcagactccgtgaagggccggttcaccatctcccgcgacaattccaagaacacgctgtatctgcaaatgaacagcctgcgtgccgaggataccgcggtatattactgtgcgaaaattcgtaatctgcattgggatgtggggaggcagtttgactactggggtcagggaaccctggtcaccgtctcgagc

SEQ ID NO: 895 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgatgatggtactatggggtgggcccgccaggctccagggaagggtctagagtgggtctcacttattttgccgtcgggtagtcgtacatactacgcagactccgtgaagggccggttcaccatctcccgcgacaattccaagaacacgctgtatctgcaaatgaacagcctgcgtgccgaggacaccgcggtatattactgtgcgaaacattcgctgactaatcgtccgtttgactactggggtcagggaaccctggtcaccgtctcgagc

SEQ ID NO: 896 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttagtaagtatgatatgcggtgggcccgccaggctccagggaagggtctagagtgggtctcagatattgatgctgttggtactcggacatactacgcagactccgtgaagggccggttcaccatctcccgcgacaattccaagaacacgctgtatctgcaaatgaacagcctgcgtgccgaggacaccgcggtatattactgtgcgataccgggggggacgtttgactactggggtcagggaaccctggtcaccgtctcgagc

SEQ ID NO: 897 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgagatgtatggtatgatgtgggcccgccaggctccagggaagggtctagagtgggtctcatctattgagggtgcgggtcatgcgacatactacgcagactccgtgaagggccggttcaccatctcccgcgacaattccaagaacacgctgtatctgcaaatgaacagcctgcgtgccgaggacactgcggtatattactgtgcgatagtgcttggtatgtttgactactggggtcagggaaccctggtcaccgtctcgagc

SEQ ID NO: 898 - DNA, 372 bp, Artificial Sequence
  Description of Artificial Sequence: Synthetic polynucleotide
gaggtgcagctgttggagtctgggggaggcttggtacagcctggggggtccctgcgtctctcctgtgcagcctcgggattcacctttttgcagtatccgatgggttgggtccgccaggctccagggaagggtctagagtgggtctcaactatttctcctgttggtttgactacatactacgcagactccgtgaagggccggttcaccatctcccgcgacaattccaagaacacgctgtatctgcaaatgaacagcctgcgtgccgaggataccgcggtatattactgtgcgaaattgtttgaggggtcgaggattcagcgtgatgtgggttttgactactggggtcagggaaccctggtcaccgtctcgagc

SEQ ID NO: 899 - DNA, 369 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgagaagtatcagatgggttgggcccgccaggctccagggaagggtctagagtgggtctcatcgattcgggggtctggtcttgttacatactacgcagactccgtgaagggccggttcaccatctcccgcgacaattccaagaacacgctgtatctgcaaatgaacagcctgcgtgccgaggacaccgcggtatattactgtgcgaaagtgcatactacgctgcatacggaggtgattgggtttgactactggggtcagggaaccctggtcaccgtctcgagc

SEQ ID NO: 900 - DNA, 348 bp, Artificial Sequence
  Description of Artificial Sequence: Synthetic polynucleotide
gaggtgcagctgttggagtctgggggaggcttggtacagccgggggggtccctgcgtctctcctgtgcagcctccggattcacctttagtcagtatacgatgtattgggcccgccaggctccagggaagggtctagagtgggtctcagagatttctcatagtggttctaatacatactacgcagactccgtgaagggccggttcaccatctcccgcgacaattccaagaacacgctgtatctgcaaatgaacagcctgcgtgccgaggacaccgcggtatattactgtgcgatatcggggctgcattttgactactggggtcagggaaccctggtcaccgtctcgagc

SEQ ID NO: 901 - DNA, 360 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcaccttttcggattatgcgatggcttgggtccgccaggctccagggaagggtctggagtgggtctcacgtattggtgtggagggtggggatacatactacgcagactccgtgaagggccggttcaccatctcccgcgacaattccaagaacacgctgtatctgcaaatgaacagcctgcgtgccgaggacaccgcggtatattactgtgcgaaattgttgcggctttatcgtctggggtttgactactggggtcagggaaccctggtcaccgtctcgagc

SEQ ID NO: 902 - DNA, 363 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgctaagtatgatatgacgtgggtccgccaggctccagggaagggtctagagtgggtctcaaagattaattctgatggtggtcttacatactacgcagactccgtgaagggccggttcaccatctcccgcgacaattccaagaacacgctgtatctgcaaatgaacagcctgcgtgccgaggacaccgcggtatattactgtgcgaaagggttgcatggtagggggtttgttatttttgactactggggtcagggaaccctggtcaccgtctcgagc

SEQ ID NO: 903 - DNA, 372 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcaccttttcgcggtatgatatggtgtgggtccgccaggctccagggaagggtctagagtgggtctcacggattaattctatgggtctggctacatactacgcagactccgtgaagggccggttcaccatctcccgcgacaattccaagaacacgctgtatctgcaaatgaacagcctgcgtgccgaggataccgcggtatattactgtgcgaaagattattcggttgcgccgcatgggtatcctttgggttttgactactggggtcagggaaccctggtcaccgtctcgagc

SEQ ID NO: 904 - DNA, 366 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaaggattattcgatgatgtgggtccgccaggctccagggaagggtctagagtgggtctcaacgattactgataatggtacgtctacatactacgcagactccgtgaagggccggttcaccatctcccgcgacaattccaagaacacgctgtatctgcaaatgaacagcctgcgtgccgaggacaccgcggtatattactgtgcgaaacatatgtcgcttgctacttatctgcagttttttgactactggggtcagggaaccctggtcaccgtctcgagc

SEQ ID NO: 905 - DNA, 369 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttatggagtatgatatgctttgggtccgccaggctccagggaaggctctagagtgggtctcacgtatttcgtcggatggtctttggacatactacgcagactccgtgaagggccggttcaccatctcccgcgacaattccaagaacacgctgtatctgcaaatgaacagcctgcgtgccgaggacaccgcggtatattactgtgcgaaaggggtgagtgcgcttgctccttttgatattggttttgactactggggtcagggaaccctggtcaccgtctcgagc

SEQ ID NO: 906 - DNA, 363 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaaggagtataatatggcttgggtccgccaggctccagggaagggtctggagtgggtctcaagtattaattttgctggtcggacgacatactacgcagactccgtgaagggccggttcaccatctcccgcgacaattccaagaacacgctgtatctgcaaatgaacagcctgcgtgccgaggacaccgcggtatattactgtgcgaaactgtctcttcctttggatattttttcttttgactactggggtcagggaaccctggtcaccgtctcgagc

SEQ ID NO: 907 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttggtgattatggtatgaattgggtccgccaggctccagggaagggtctggagtgggtctcacatatttcttctaatggtcgttttacatactacgcagactccgtgaagggccggttcaccatctcccgcgacaattccaagaacacgctgtatctgcaaatgaacagcctgcgtgccgaggacaccgcggtatattactgtgcggaaactagtggttattttgactactggggtcagggaaccctggtcaccgtctcgagc

SEQ ID NO: 908 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttggtgattatggtatgaattgggtccgccaggctccagggaagggtctggagtgggtctcacatatttcttctaatggtcgttttacatactacgcagactccgtgaagggccggttcaccatctcccgcgacaattccaagaacatgctgtatctgcgaatgaacagcctgcgtgccgaggacaccgcggtatattactgtgcggaaactagtggttattatgaatactggggtcagggaaccctggtcaccgtctcgagc

SEQ ID NO: 909 - DNA, 348 bp, Artificial Sequence
  Description of Artificial Sequence: Synthetic polynucleotide
gaggtgcagctgttggagtctgggggaggcttggtacagcctggggggtccctgcgcctctcctgtgcagcctccggattcacctttggtgattatggtatgaattgggtccgccaggctccagggaagggtctggagtgggtctcacatatttcttctaatggtcgttttacatactacgcagactccgtgaagggccggttcaccatctcccgcgacaattccaagaacacgctgtatctgcaaatgaacagcctgcgtgccgaggacaccgcggtatattactgtgcggaaactagtggttattttgaatactggggtcagggaaccctggtcaccgtctcgagc

SEQ ID NO: 910 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttggtgattatggtatgaattgggtccgccaggccccagggaagggtctggagtgggtctcacatatttcttctaatggtcgttttacatactacgcagactccgtgaagggccggttcaccatctcccgcgacaattccaagaacacgctgtatctgcaaatgaacagcctgcgtgccgaggacaccgcggtatattactgtgcggaaactagtagttattttgaatactggggtcagggaaccctggtcaccgtctcgagc

SEQ ID NO: 911 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccgggttcacctttggtgattatggtatgaattgggtccgccaggctccagggaagggtctggagtgggtctcacatatttcttctaatggtcgttttacatactacgcagactccgtgaagggccggttcaccatctcccgcgacaattccaagaacacgctgtttctgcaaatgaacagcctgcgtgccgaggacaccgcggtatattactgtgcggaaactagtggttattatgagtactggggtcatggaaccctggtcaccgtctcgagc

SEQ ID NO: 912 - DNA, 348 bp, Artificial Sequence
  Description of Artificial Sequence: Synthetic polynucleotide
gaggtgcagctgttggagtctgggggaggcttggtccagcctggggggtccctgcgtctctcctgtgctgcctccggattcgcctttggtgattatggtatgaattgggtccgccaggctccagggaagggtctggagtgggtctcacatatttcttctaatggtcgttttacatactacgcagactccgtgaagggccggttcaccatctcccgcgacaattccaagaacacgctgtatctgcaaatgaacagcctgcgtgccgaggacaccgcggtatattactgtgcggaaactagtggttattttgaatactggggtcagggaaccctggtcaccgtctcgagc

SEQ ID NO: 913 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttggtgattatggtatgaattgggtccgccaggctccagggaagggtctggagtgggtctcacatatttcttctaatggtcgttttatatactacgcagactccgtgaagggccggttcaccatctcccgcgacaattccaagaacacgctgtatctgcaaatgaacagcctgcgtgccgaggacaccgcggtatattactgtgcggaaactagtggttactttgaatactggggtcagggaaccctggtcaccgtctcgagc

SEQ ID NO: 914 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttagggagtatgttatggggtgggtccgccaggctccagggaagggtctagagtgggtctcaactattaatggtttgggtaatgttacatactacgcagactccgtgaagggccggttcaccatctcccgcgacaataccaagaacacgctgtatctgcaaatgaacagcctgcgtgccgaggagaccgcggtatattactgtgcgatacagctgcctaattttgactactggggtcagggaaccctggtcaccgtctcgagc

SEQ ID NO: 915 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttggtaatgatgggatgtggtgggtccgccaggctccagggaagggtctagagtgggtctcatttattaatgttgatggtagggagacatactacgcagactccgtgaagggccggttcaccatctcccgcgacaattccaagaacacgctgtatctgcaaatgaacagcctgcgtgccgaggataccgcggtatattactgtgcggaatggtctcctgggcgggttcagtttgactactggggtcagggaaccctggtcaccgtctcgagc

SEQ ID NO: 916 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttggtggttgggatatggcgtgggtccgccaggctccagggaagggtctagagtgggtctcaagtattgctcatgagggtggtgagacatactacgcagactccgtgaagggccggttcaccatctcccgcgacaattccaagaacacgctgtatctgcaaatgaacagcctgcgtgccgaggacaccgcggtatattactgtgcgaaatatgttcctgggtctcctctgtttgactactggggtcagagaaccctggtcaccgtctcgagc

SEQ ID NO: 917 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgatcagggttggatgtattgggtccgccaggctccagggaagggtctagagtgggtctcagggattggttcgaatggtcctcggacatcctacgcagactccgtgaagggccggttcaccatctcccgcgacaattccaagaacacgctgtatctgcaaatgaacagcctgcgtgccgaggacaccgcggtatattactgtgcgaaatcgggggagtattttgactactggggtcagggaaccctggtcaccgtctcgagc

SEQ ID NO: 918 - DNA, 351 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaggcagagtgatatgtggtgggtccgccaggctccagggaagggtctagagtgggtctcagttattggtaataatggtgagtttacatactacgcagactcggtgaagggccggttcaccatctcccgcgacaattccaagaacacgctgtatctgcaaatgaacagcctgcgtgccgaggacaccgcggtatattactgtgcgaaagataattggctgttgtttgactactggggtcagggaaccctggtcaccgtctcgagc

SEQ ID NO: 919 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgatcttagtactatgtattgggtccgccaggctccagggaagggtctagagtgggtctcaactattggtggggatggtagtcatacatactacgcagactccgtgaagggccggttcaccatctcccgcgacaattccaagaacacgctgtatctgcaaatgaacagcctgcgtgccgaggataccgcggtatattactgtgcggaaggtacgcagtattttgactactggggtcagggaaccctggtcaccgtctcgagc

SEQ ID NO: 920 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcaccttttcggcgtatacgatggagtgggtccgccaggctccagggaagggtctagagtgggtctcaagtattggggttacgggttatgatacatactacgcagactccgtgaagggccggttcaccatctcccgcgacaattccaagaacacgctgtatctgcaaatgaacagcctgcgtgccgaggacaccgcggtatattactgtgcgaaaggtggtcagggttttgactactggggtcagggaaccctggtcaccgtctcgagc

SEQ ID NO: 921 - DNA, 372 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttggggattatgggatgtcttgggtccgccaggctccagggaagggtctagagtgggtctcatatattgatcctctgggtcgtcttacatactacgcagactccgtgaagggccggttcaccatctcccgcgacaattccaagaacacgctgtatctgcaaatgaacagcctgcgtgccgaggacaccgcggtatattactgtgcggaagatttgtcgtcgctgcagtatggggtgtcgcctaattttgactactggggtcagggaaccctggtcaccgtctcgagc

SEQ ID NO: 922 - DNA, 363 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcaccttttttcattattctatgagttgggtccgccaggctccagggaagggtctagagtgggtctcatctattggtccggttggtcgggagacatactacgcagactccgtgaagggccggttcaccatctcccgcgacaattccaagaacacgctgtatctgcaaatgaacagcctgcgtgccgaggacaccgcggtatattactgtgcgaaaatgattcagtcgccgttgtttaaggattttgactactggggtcagggaaccctggtcaccgtctcgagc

SEQ ID NO: 923 - DNA, 360 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgagtggtatgatatgtattgggtccgccaggctccagggaagggtctagagtgggtctcacgtattgatagtgggggtaatcagacatactacgcagactccgtgaagggccggttcaccatctcccgcgacaattccaagaacacgctgtatctgcaaatgaatagcctgcgtgccgaggacaccgcggtatattactgtgcggaagcgtcgctttggaagtggaggttgtttgactactggggtcagggaaccctggtcaccgtctcgagc

SEQ ID NO: 924 - DNA, 366 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgaggagtatggtatggcgtgggtccgccaggctccagggaagggtctagagtgggtctcaactatttctccgctgggtatttcgacatactacgcagactccgtgaagggccggttcaccatctcccgcgacaattccaagaacacgctgtatctgcaaatgaacagcctgcgtgccgaggacaccgcggtatattactgtgcgaaacatgctacgtctcaggagtctttgcggtcttttgactactggggtcagggaaccctggtcaccgtctcgagc

SEQ ID NO: 925 - DNA, 369 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttagtaagtatgagatgatgtgggtccgccaggctccagggaagggtctagagtgggtctcagctattagtggtagtggtggtagcacatactacgcagactccgtgaagggccggttcaccatctcccgcgacaattccaagaacacgctgtatctgcaaatgaacagcctgcgtgccgaggacaccgcggtatattactgtgcgaaaggtcctctgcctgatgcgttttggactaggggttttgactactggggtcagggaaccctggtcaccgtctcgagc

SEQ ID NO: 926 - DNA, 363 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttggtacttattctatggcgtgggtccgccaggctccagggaagggtctagagtgggtctcaactattgatcggcatggtttggctacatactacgcagactccgtgaagggccggttcaccatctcccgcgacaattccaagaacacgctgtatctgcaaatgaacagcctgcgtgccgaggacaccgcggtatattactgtgcgaaaactcctggttcttcttggcagactgtttttggctactggggtcagggaaccctggtcaccgtctcgagc

SEQ ID NO: 927 - DNA, 363 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgagtcgtatcctatgggttgggtccgccaggctccagggaagggtctagagtgggtctcaagtattgatcatcatggtcattcgacatactacgcagactccgcgaagggccggttcaccatctcccgcgacaattccaagaacacgctgtatctgcaaatgaacagcctgcgtgccgaggacaccgcggtatattactgtgcgaaattgcttagggtttcgatgatttttggttttgactactggggtcagggaaccctggtcaccgtctcgagc

SEQ ID NO: 928 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgtgcagtatgggatgagttgggtccgccaggctccagggaagggtctagagtgggtctcatggattagtagtagtggtacgtatacatactacgcagactccgtgaagggccggttcaccatctcccgcgacaattccaagaacacgctgtatctgcaaatgaacagcctacgtgccgaggacaccgcggtatattactgtgcggaaacgtctaggatgtttgactactggggtcagggaaccctggtcaccgtctcgagc

SEQ ID NO: 929 - DNA, 363 bp, Artificial Sequence
  Description of Artificial Sequence: Synthetic polynucleotide
gaggtgcagctgttggagtctgggggaggcttggtacagcctggggggtccctgcgtctctcctgtgcggcctccggattcacctttcgggagtatgatatgggttgggtccgccaggctccagggaagggtctagagtgggtctcacttatttcgcctcctggtcgtactacatactacgcagactccgtgaagggccggttcaccatctcccgcgacaattccaagaacacgctgtatctgcaaatgaacagcctgcgtgccgaggataccgcggtatattactgtgcgaaagttgtgattctgggttatacgaataggtttgactactggggtcagggaaccctggtcaccgtctcgagc

SEQ ID NO: 930 - DNA, 372 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcctaattacgggatgttgtgggtccgccaggctccagggaagggtctagagtgggtctcatcgattaattcttcgggtatggagacatactacgcagactccgtgaagggccggttcaccatctcccgcgacaattccaagaacacgctgtatctgcaaatgaacagcctgcgtgccgaggataccgcggtatattactgtgcgaaattttttcgtctgaatgatcataattctgtgtttggttttgactactggggtcagggaaccctggtcaccgtctcgagc

SEQ ID NO: 931 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaaggattataagatgatgtggatccgccaggctccagggaagggtctagagtgggtctcatcgattgttgggtctggttcgatgacatactacgcagactccgtgaagggccggttcaccatctcccgcgacaattccaagaacacgctgtatctgcaaatgaacagcctgcgtgccgaggacaccgcggtatattactgtgcgaaagggcctggttattttgactactggggtcagggaaccctggtcaccgtctcgagc

SEQ ID NO: 932 - DNA, 360 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcataattatgctatggggtgggtccgccgggctccagggaagggtctagagtgggtctcaagtattgatgagcatggtactattacatactacgcagactccgtgaagggccggttcaccatctcccgcgacaattccaagaacacgctgtatctgcaaatgaacagcctgcgtgccgaggacaccgcggtatattactgtgcgaaagatagtctggatcgggtttggatttttgactactggggtcagggaaccctggtcaccgtctcgagc

SEQ ID NO: 933 - DNA, 366 bp, Artificial Sequence
  Description of Artificial Sequence: Synthetic polynucleotide
gaggtgcagctgttggagtctggggggggcttggtacagcctggggggtccctgcgtctctcctgtgcagcctccggattcacctttgctgattatccgatgacttgggtccgccaggctccagggaagggtctagagtgggtctcaagtatttattctgcgggttctcctacatactacgcagactccgtgaagggccggttcaccatctcccgcgacaattccaagaacacgctgtatctgcaaatgaacagcctgcgtgccgaggataccgcggtatattactgtgcgaaactttatcatcgggagccgattctttttgggtttgactactggggtcagggaaccctggtcaccgtctcgagc

SEQ ID NO: 934 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgagaggtatcagatggcgtgggtccgccaggctccggggaagggtctagagtgggtctcaacgattagttctgatggtggggggacatactacgcagactccgtgaagggccggttcaccatctcccgcgacaattccaagaacacgctgtatctgcaaatgaacagcctgcgtgccgaggacaccgcggtatattactgtgcgaaacctggtcatcggtttgactactggggtcagggaaccctggtcaccgtctcgagc

SEQ ID NO: 935 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttggttcttatactatgatgtgggtccgccaggctccagggaagggtctagagtgggtctcagagattgatcggacgggtgagcgtacatactacgcagactccgtgaagggccggttcaccatctcccgcgacaattccaagaacacgctgtatctgcaaatgaacagcctgcgtgccgaggacaccgcggtatattactgtgcggaacctgggtttgcttctcttccttttgactactggggtcagggaaccctggtcaccgtctcgagc

SEQ ID NO: 936 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttacggattatactatgtattgggtccgccaggctccagggaagggtctagagtgggtctcaaagatttctccgagtggtcgttctacatactacgcagactccgtgaagggccggttcaccatctcccgcgacaattccaagaacacgctgtatctgcaaatgaacagcctgcgtgccgaggataccgcggtatattactgtgcgaaagatccgtttgggtttgactactggggtcagggaaccctggtcaccgtctcgagc

SEQ ID NO: 937 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgatgatgcggagatgttttgggtccgccaggctccagggaagggtctagagtgggtctcatctattgatgctcgtggtttgacgacatactacgcagaccccgtgaagggccggttcaccatctcccgcgacaattccaagaacacgctgtatctgcaaatgaacagcctgcgtgccgaggacaccgcggtatattactgtgcggaagcgacgtcggctatgtatccttttgactactggggtcagggaaccctggtcaccgtctcgagc

SEQ ID NO: 938 - DNA, 363 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgtgattatgatatgggttgggtccgccaggctccagggaagggtctagagtgggtctcaactatttctcctcttggtcattttacatactacgcagactccgtgaagggccggttcaccatctcccgcgacaattccaagaacacgctgtatctgcaaatgaacagcctgcgtgccgaggataccgcggtatattactgtgcgaaatctgggtttcatgagtatactgaggggtttgactactggggtcagggaaccctggtcaccgtctcgagc

SEQ ID NO: 939 - DNA, 369 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgatcgtgcgggtatggggtgggtccgccaggctccagggaagggtctagagtgggtctcactgattgggcgtggtggtgatattacatactacgcagactccgtgaagggccggttcaccatctcccgcgacaattccaagaacacgctgtatctgcaaatgaacagcctgcgtgccgaggacaccgcggtatattactgtgcgaaaattcgtaatctgcattgggatgtggggaggcagtttgactactggggtcagggaaccctggtcaccgtctcgagc

SEQ ID NO: 940 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttggtcgttatcagatggcttgggtccgccaggctccagggaagggtctagagtgggtctcatctatttcttctgatggtggggggacatactacgcagactccgtgaagggccggttcaccatctcccgcgacaattccaagaacacgctgtatctgcaaatgaacagcctgcgtgccgaggacaccgcggtatattactgtgcgaaaccgtctcgtcggtttgactactggggtcagggaaccctggtcaccgtctcgagc

SEQ ID NO: 941 - DNA, 369 bp, Artificial Sequence
  Description of Artificial Sequence: Synthetic polynucleotide
gaggtgcagctgttggagtctgggggaggcttggtacagcctggggggttcctgcgtctctcctgtgcagcctccggattcacctttgagttgtatccgatggcgtgggtccgccaggctccagggaagggtctggagtgggtctcatcgatttctccggttggttttctgacatactacgcagactccgtgaagggccggttcaccatctcccgcgacaattccaagaacacgctgtatctgcaaatgaacagcctgcgtgccgaggataccgcggtatattactgtgcgaaagggcatgaggggtcgtatactccgcggtcggcttttgactactggggtcagggaaccctggtcaccgtctcgagc

SEQ ID NO: 942 - DNA, 369 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgtggcgtatcctatggcgtgggtccgccaggctccagggaagggtctggagtgggtctcaactattgcgcctctgggtggtaatacatactacgcagactccgtgaagggccggttcaccatctcccgcgacaattccaagaacacgctgtatctgcaaatgaacagcctgcgtgccgaggacaccgcggtatattactgtgcgaaacggccggaggggctgcagattgattctcagaattttgactactggggtcagggaaccctggtcaccgtctcgagc

SEQ ID NO: 943 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgcgttgtatcagatggcttgggtccgccaggctccagggaagggtctagagtgggtctcatcgattgattcttctggtagtgatacatactacgcagactccgtgaagggccggttcaccatctcccgcgacaattccaagaacacgctgtatctgcaaatgaacagcctgcgtgccgaggacaccgcggtatattactgtgcgaaacctgagcgtgattttgactactggggtcagggaaccctggtcaccgtctcgagc

SEQ ID NO: 944 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaggcagtaccagatggcttgggcccgccaggctccagggaagggtctagagtgggtctcaacgattgcgtcggatggtgtttctacatactacgcagactccgtgaagggccggttcaccatctcccgcgacaattccaagaacacgctgtatctgcaaatgaacagcctgcgtgccgaggacaccgcggtatattactgtgcgaaagttggtcgtgattttgactactggggtcagggaaccctggtcaccgtctcgagc

SEQ ID NO: 945 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgagcagtatgatatgaggtgggtccgccaggctccagggaagggtctagagtgggtctcatggattgatgaggcgggtcatgagacatactatgcagactccgtgaagggccggttcaccatctcccgcgacaattccaggaacacgctgtatctgcaaatgaacagcctgcgtgccgaggacaccgcggtatattactgtgcgaaagggatggatgggtttgactactggggtcagggaaccctggtcaccgtctcgagc

SEQ ID NO: 946 - DNA, 369 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgttgattatccgatgggttgggtccgccaggctccagggaagggtctagagtgggtctcaacgatttctacggggggtttttcgacatactacgcagactccgtgaagggccggttcaccatctcccgcgacaattccaagaacacgctgtatctgcaaatgaacagcctgcgtgccgaggacaccgcggtatattactgtgcgaaagcgcggtattattatcttagtcagattaagaattttgactactggggtcagggaaccctggtcaccgtctcgagc

SEQ ID NO: 947 - DNA, 360 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgatatttatgggatgacttgggtccgccaggctccagggaagggtctggagtgggtctcaagtatttcgcctcttggtcttgttacatactacgcagaccccgtgaagggccggttcaccatctcccgcgacaattccaagaacacgctgtatctgcaaatgaacagcctgcgtgccgaggacaccgcggtatattactgtgcgaaactgaaggagcatggggatgttccttttgactactggggtcagggaaccctggtcaccgtctcgagc

SEQ ID NO: 948 - DNA, 369 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgagctttatccgatgagttgggtccgccaggctccagggaagggtctagagtgggtctcaactatttctcctacgggtttgttgacatactacgcagactccgtgaagggccggttcaccatctcccgcgacaattccaagaacacgctgtatctgcaaatgaacagcctgcgtgccgaggacaccgcggtatattactgtgcgaaatttaagaggagtgggaagactgatgatactaattttgactactggggtcagggaaccctggtcaccgtctcgagc

SEQ ID NO: 949 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggagtatgatatgctgtgggtccgccaggctccagggaagggtctagagtgggtctcaacgattgtgggggatggtaatggtacatactacgcagactccgtgaagggccggttcaccatctcccgcgacaattccaagaacacgctgtatctgcaaatgaacagcctgcgtgccgaggacaccgcggtatattactgtgcgaaacaggatcgtcagtttgactactggggtcagggaaccctggtcaccgtctcgagc

SEQ ID NO: 950 - DNA, 360 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgaggagtatggtatgagttgggtccgccaggctccagggaagggtctagagtgggtctcaacgatttcgcctattggtgttactacatactacgcagactccgtgaagggccggttcaccatctcccgcgacaattccaagaacacgctgtatctgcaaatgaacagcctgcgtgccgaggataccgcggtatattactgtgcgaaaaatgcttatgatcggaagtctaattttgactactggggtcagggaaccctggtcaccgtctcgagc

SEQ ID NO: 951 - DNA, 372 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgatcggtatgtgatggtgtgggtccgccaggctccagggaaggatctagagtgggtctcaggtattactccgagtggtaggaggacatactacgcagactccgtgaagggccggttcaccatctcccgcgacaattccaaggacacgctgtatctgcaaatgaacagcctgcgtgccgaggacaccgcggtatattactgtgcgaaagtgttggggcgtcattttgatcctcttctgccttcgtttgactactggggtcagggaaccctggtcaccgtctcgagc

SEQ ID NO: 952 - DNA, 369 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgaggattatgctatgagttgggtccgccaggctccagggaagggtctagagtgggtctcaactattactccgggtggtttttggacatactacgcagactccgtgaagggccggttcaccatctcccgcgacaattccaagaacacgctgtatctgcaaatgaacagcctgcgtgccgaggataccgcggtatattactgtgcgaaaacgtctagtggggagttgcagttggttgaggattttgactactggggtcagggaaccctggtcaccgtctcgagc

SEQ ID NO: 953 - protein, 108 aa, Artificial Sequence
  Description of Artificial Sequence: Synthetic polypeptide
DIQMTQSPSSLSASVGDRVTITCRASQNIKHSLRWYQQKPGKAPRLLIYHRSQLQSGVPSRFSGSGSGTDFTLTISSLQPEDFATYYCQQVRHRPYTFGQGTKVEIKR

SEQ ID NO: 954 - protein, 108 aa, Artificial Sequence
  Description of Artificial Sequence: Synthetic polypeptide
DIQMTQSPSSLSASVGDRVTITCRASQAIGHRLRWYQQKPGKAPKLLIYHRSKLQSGVPSRFSGSGSGTDFTLTISSLQPEDFATYYCQQVALFPYTFGQGTKVEIKR

SEQ ID NO: 955 - protein, 108 aa, Artificial Sequence
  Description of Artificial Sequence: Synthetic polypeptide
DIQMTQSPSSLSASVGDRVTITCRASQHIGHHLRWYQQKPGKAPKLLIYHRSHLQSGVPSRFSGSGSGTDFTLTISSLQPEDSATYYCQQWDRPPYTFGQGTKVEIKR

SEQ ID NO: 956 - protein, 108 aa, Artificial Sequence
  Description of Artificial Sequence: Synthetic polypeptide
DIQMTQSPSSLSASVGDRVTITCRASQAIGHRLRWYQQKPGKAPKLLIYHRSKLQSGVPSRFSGSGSGTDFTLTISSLQPEDFATYYCQQVRAVPYTFGQGTKVEIKR

SEQ ID NO: 957 - protein, 108 aa, Artificial Sequence
  Description of Artificial Sequence: Synthetic polypeptide
DIQMTQSPSSLSASVGDRVTITCRASQAIGHRLRWYQQKPGKAPKLLIYHRSKLQSGVPSRFSGSGSGTDFTLTISSLQPEDFATYYCQQVRFSPYTFGQGTKVEIKR

SEQ ID NO: 958 - protein, 108 aa, Artificial Sequence
  Description of Artificial Sequence: Synthetic polypeptide
DIQMTQSPSSLSASVGDRVTITCRASQAIGHRLRWYQQKPGKAPKLLIYHRSKLQSGVPSRFSGSGSGTDFTLTISSLQPEDFATYYCQQSYARPVTFGQGTKVEIKR

SEQ ID NO: 959 - protein, 108 aa, Artificial Sequence
  Description of Artificial Sequence: Synthetic polypeptide
DIQMTQSPSSLSASVGDRVTITCRASQSINHRLYWYQQKPGKAPKLLIYHRSRLQSGVPSRFSGSGSGTDFTLTISSLQPEDFATYYCQQYKVRPNTFGQGTKVEIKR

SEQ ID NO: 960 - protein, 108 aa, Artificial Sequence
  Description of Artificial Sequence: Synthetic polypeptide
DIQMTQSPSSLSASVGDRVTITCRASQAIGHRLRWYQQKPGKAPKLLIYHRSKLQSGVPSRFSGSGSGTDFTLTISSLQPEDFATYYCQQTYSSPHTFGQGTKVEIKR

SEQ ID NO: 961 - protein, 108 aa, Artificial Sequence
  Description of Artificial Sequence: Synthetic polypeptide
DIQMTQSPSSLSASVGDRVTITCRASQAIGHRLRWYQQKPGKAPKLLIYHRSKLQSGVPSRFSGSGSGTDFTLTISSLQPEDFATYYCQQRAVRPFTFGQGTKVEIKR

SEQ ID NO: 962 - protein, 108 aa, Artificial Sequence
  Description of Artificial Sequence: Synthetic polypeptide
DIQMTQSPSSLSASVGDRVTITCRASQAIGHRLRWYQQKPGKAPKLLIYHRSKLQSGVPSRFSGSGSGTDFTLTISSLQPEDFATYYCQQTYYRPLTFGQGTKVEIKR

SEQ ID NO: 963 - protein, 108 aa, Artificial Sequence
  Description of Artificial Sequence: Synthetic polypeptide
DIQMTQSPASLSASVGDRVTITCRASQDIDPMLRWYQQKPGKAPKLLIYAGSILQSGVPSRFSGSGSGTDFTLTISSLQPEDFATYYCQQTSIRPYTFGQGTKVEIKR

SEQ ID NO: 964 - protein, 108 aa, Artificial Sequence
  Description of Artificial Sequence: Synthetic polypeptide
DIQMTQSPSSLSASVGDRVTITCRASQPIGPDLLWYQQKPGKAPKLLIYQTSILQSGVPSRFSGSGSGTDFTLTISSLQPEDFATYYCQQYWAFPVTFGQGTKVEIKR

SEQ ID NO: 965 - protein, 108 aa, Artificial Sequence
  Description of Artificial Sequence: Synthetic polypeptide
DIQMTQSPSSLSASVGDRVTITCRASQPIGPDILWYQQKPGKAPKLLIYQTSILQSGVPSRFSGSESGTDFTLTISSLQPEDFATYYCQQYWAFPVTFGQGTKVEIKR

SEQ ID NO: 966 - protein, 108 aa, Artificial Sequence
  Description of Artificial Sequence: Synthetic polypeptide
DIQITQSPSSLSASVGDRVTITCRASQPIGPDLLWYQQKPGKAPKLLIYQTSILRSGVPSRFSGSGSGTDFTLTISSLQPEDLATYYCQQYWAFPVTFGQGTKVEIKR

SEQ ID NO: 967 - protein, 108 aa, Artificial Sequence
  Description of Artificial Sequence: Synthetic polypeptide
DIQMTQSPSSLSASVGDRVTITCRASQPIGPDLLWYQQKPGKAPKLLIYQTSILRSGVPSRFSGRGSGTDFTLTISSLQPEDFATYYCQQYWAFPVTFGQGTKVEIKR

SEQ ID NO: 968 - protein, 108 aa, Artificial Sequence
  Description of Artificial Sequence: Synthetic polypeptide
DIQMTQSPSSLSASVGDRVTITCRASQPIGPDLLWYQQKPGKAPKLLIYQTSILRSGVPSRFSGSGSGTDFTLTISSLQPEDFATYYCQQYWTFPVTFGQGTKVEIKR

SEQ ID NO: 969 - protein, 108 aa, Artificial Sequence
  Description of Artificial Sequence: Synthetic polypeptide
DIQMTQSPSSLSASVGDRVTITCRASQPIGPDLLWYQQKPGKAPKLLIYQTSILRSGVPSRFSGSGSETDFTLTISNLQPEDFATYYCQQYWAFPVTFGQGTKVVIKR

SEQ ID NO: 970 - protein, 108 aa, Artificial Sequence
  Description of Artificial Sequence: Synthetic polypeptide
DIQMTQSPSSLSASVGDRVTITCRASQPIGPDLLWYQQKPGKAPKLLIYQTSILRSGVPSRFSGSGSETDFTLTISNLQPEDLATYYCQQYWAFPVTFGKGTKVVIKR

SEQ ID NO: 971 - protein, 108 aa, Artificial Sequence
  Description of Artificial Sequence: Synthetic polypeptide
DIQMTQSPSSLSASVGDRVTITCRASQPIGPDLLWYQQKPGKAPKLLIYQTSILRSGVPSRFSGSGSETDFTLTISNLQPEDFATYYCQQYWAFPVTFGRGTKVVIKR

SEQ ID NO: 972 - protein, 108 aa, Artificial Sequence
  Description of Artificial Sequence: Synthetic polypeptide
DIQMTQSPSSLSASVGDRVTITCRASQPIGPDLLWYRQKPGKAPKLLIYQTSILRSGVPSRFSGSGSETDFTLTISNLQPEDFATYYCQQYWAFPVTFGQGTKVVIKR

SEQ ID NO: 973 - protein, 108 aa, Artificial Sequence
  Description of Artificial Sequence: Synthetic polypeptide
DIQMTQSPSSLSASVGDRVTITCRASQPIGPDLLWYQQKPGKAPKLLIYQTSIMRSGVPSRFSGSGSETDFTLTISNLQPEDFATYYCQQYWTFPVTFGQGTKVEIKR

SEQ ID NO: 974 - protein, 108 aa, Artificial Sequence
  Description of Artificial Sequence: Synthetic polypeptide
DIQMTQSPSSLSAYVGDRVTITCRASQPIGPDLLWYQQKPGKAPKLLIYQTSILRSGVPSRFSGSGSETDFTLTISNLQPEDFAKYYCQQYWAFPVTFGQGTKVVIKR

SEQ ID NO: 975 - protein, 108 aa, Artificial Sequence
  Description of Artificial Sequence: Synthetic polypeptide
DIQMTQSPSSLSASVGDRVTITCRASQPIGPDLLWYQQKPGKAPKLLIYQTSILRSGVPSRFSGSGSETDFTLTISNLQPVDFATYYCQQYWAFPVTFGQGTKVVIKR

SEQ ID NO: 976 - protein, 108 aa, Artificial Sequence
  Description of Artificial Sequence: Synthetic polypeptide
DIQMTQSPSSLSASVGDRVTITCRASQPIGPDLLWFQQKPGKAPKLLIYQTSILQSGVPSRFSGSESGTDFTLTISSLQPEDFATYYCQQYWAFPVTFGQGTKVEIKR

SEQ ID NO: 977 - protein, 108 aa, Artificial Sequence
  Description of Artificial Sequence: Synthetic polypeptide
DIQMTQSPSSLSASVGDRVTITCRASQPIGPDLLWYRQKPGKAPKLLIYQTSILQSGVPSRFSGSGSGTDFTLTISSLQPEDFATYYCQQYWTFPVTFGQGTKVEIKR

SEQ ID NO: 978 - protein, 108 aa, Artificial Sequence
  Description of Artificial Sequence: Synthetic polypeptide
DIQMTQSPSSLSASVGDRVTITCRASQPIDPDLLWYQQKPGKAPKLLIYQTSILQSGVPSRFSGSGSGTVFTLTISSLQPEDFATYYCQQYWAFPVTFGQGTKVEIKR

SEQ ID NO: 979 - protein, 108 aa, Artificial Sequence
  Description of Artificial Sequence: Synthetic polypeptide
DIQMTQSPSSLSASVGDRVTITCRASQPIGPDLLWYQQKPGKAPKLLIYQTSILRSGVPSRFSGSGSGTDFTLTISSLQPEDFATYYCQQYWAFPVTFGQGTKVEIKR

SEQ ID NO: 980 - protein, 108 aa, Artificial Sequence
  Description of Artificial Sequence: Synthetic polypeptide
DIQMTQSPSSLSASVGDRVTITCRASQPIEPDLLWYQQKPGKAPKLLIYQTSILQSGVPSRFSGSGSGTDFTLTISSLQPEDFATYYCQQYWASPVTFGQGTKVEIKR

SEQ ID NO: 981 - protein, 108 aa, Artificial Sequence
  Description of Artificial Sequence: Synthetic polypeptide
DIQMTQSPSSLSASVGDRVTITCRASQPIGPDLLWYQQKPGKAPKLLIYQTSILQSGVPSRFSGSESGTDFTLTISSLQPEDIATYYCQQYWAFPVTFGQGTRVEIKR

SEQ ID NO: 982 - protein, 108 aa, Artificial Sequence
  Description of Artificial Sequence: Synthetic polypeptide
DIQMTQSPSSLSASVGDRVTITCRASQPIGPDLLWYQQKPGKAPKLLIYQTSILQSGVPSRFSGSESGTDFTLTISSLQPEDFATYYCQQYWAFPVTFGQGTKVEIKR

SEQ ID NO: 983 - protein, 108 aa, Artificial Sequence
  Description of Artificial Sequence: Synthetic polypeptide
DIQMTQSPSSLSASVGDRVAITCRASQPIGPDILWYQQKPGKAPKLLIYQTSILRSGVPSRFSGSGSGTDFTLTISSLQPEDSATYYCQQYWAFPVTFGQGTKVEIKR

SEQ ID NO: 984 - protein, 108 aa, Artificial Sequence
  Description of Artificial Sequence: Synthetic polypeptide
DIQMTQSPSSLSASVGDRVTITCRASQPIGPDLLWYQQKPGKAPKLLIYQTSILRSGVPSRFSGSGSVTDFTLTISSLQPEDFATYYCQQYWAFPVTFGQGTKVGIKR

SEQ ID NO: 985 - protein, 108 aa, Artificial Sequence
  Description of Artificial Sequence: Synthetic polypeptide
DIQMTQSPSSLSASVGDRVTITCRASQPIDPDLLWYQQKPGKAPKLLIYQTSILQSGVPSRFSGSGSRTDFTLTISSLQPEDFATYYCQQYWAFPVTFGQGTKVEIKR

SEQ ID NO: 986 - protein, 108 aa, Artificial Sequence
  Description of Artificial Sequence: Synthetic polypeptide
DIQMTQSPSSLSASVGDRVTITCRASQPIGPDLLWYQQKPGKAPKLLIYQTSILQSGVPSRFSGSGSGTDFTLTISGLQPEDFATYYCQQYWAFPVTFGQGTKVEIKR

SEQ ID NO: 987 - protein, 108 aa, Artificial Sequence
  Description of Artificial Sequence: Synthetic polypeptide
DIQMTQSPSSLSASVGDRVTITCRASMPIGPDLLWYQQKPGKAPKLLIYQTSILRSGVPSRFSGSESGTDFTLTISSLQPEDFATYYCQQYWAFPVTFGQGTKVEIKR

SEQ ID NO: 988 - protein, 108 aa, Artificial Sequence
  Description of Artificial Sequence: Synthetic polypeptide
DIQMTQSPSSLSASVGDRVTITCRASQWIGDTLTWYQQKLGKAPKLLIYGGSELQSGVPPRFSGSGSGTDFTLTISSLQPEDFATYYCQQCISSPCTFGQGTKVEIKR

SEQ ID NO: 989 - protein, 108 aa, Artificial Sequence
  Description of Artificial Sequence: Synthetic polypeptide
DIQMTQSPSSLSASVGDRVTITCRASQFIGDSLSWYQQKPGKAPKLLIYFSSILQSGVPSRFSGSGSGTDFTLTISSLQPEDFATYYCQQYHTSPTTFGRGTKVKIKR

SEQ ID NO: 990 - protein, 108 aa, Artificial Sequence
  Description of Artificial Sequence: Synthetic polypeptide
DIQMTQSPSSLSASVGDRVTITCRASQTIETNLEWYQQKPGKAPKLLIYDSSQLQSGVPSRFSGSGSGTDFTLTISSLQPEDLATYYCQQYHGYPTTFGQGTKVEIKR

SEQ ID NO: 991 - protein, 108 aa, Artificial Sequence
  Description of Artificial Sequence: Synthetic polypeptide
DIQMTQSPSSLSASVGDRVTITCRASQMIDQDLEWYQQKPGKAPKLLIYNASWLQSGVPSRFSGSGSGTDFTLTISSLQPEDFATYYCQQYHGYPITFGQGTKVEIKR

SEQ ID NO: 992 - protein, 108 aa, Artificial Sequence
  Description of Artificial Sequence: Synthetic polypeptide
DIQMTQSPSSLSASVGDRVTITCRASQTIYTSLSWYQQKPGKAPKLLIHYGSVLQSGVPSRFSGSGSGTDFTLTISSLQPEDSATYYCQQVHQAPTTFGQGTKVEIKR

SEQ ID NO: 993 - protein, 108 aa, Artificial Sequence
  Description of Artificial Sequence: Synthetic polypeptide
DIRMTQSPSSLSASVGDRVTITCRASQWIGDSLAWYQQKPGKAPKLLIYGISELQSGVPSRFSGSGSGTDFTLTISSLQPEDSATYYCQLSSSMPHTFGQGTKVEIKR

SEQ ID NO: 994 - protein, 108 aa, Artificial Sequence
  Description of Artificial Sequence: Synthetic polypeptide
DIQMTQSPSSLSASVGDRVTITCRASQEIETNLEWYQQKPGKAPKLLIYDSSHLQSGVPSRFSGSGSGTDFTLTISSLQPEDFATYYCQQYHQNPPTFGQGTKVEIKR

SEQ ID NO: 995 - protein, 108 aa, Artificial Sequence
  Description of Artificial Sequence: Synthetic polypeptide
DIQMTQSPSSLSASVGDRVTITCRASQWIGRQLVWYQQKPGKAPKLLIYGATELQSGVPSRFSGSGSGTDFTLTISSLQPEDFATYYCQQQSKGPLTFGHGTKVEIKR

SEQ ID NO: 996 - protein, 108 aa, Artificial Sequence
  Description of Artificial Sequence: Synthetic polypeptide
DIQMTQSPSSLSASVGDRVTITCRASQGIGTDLNWYQQKPGKAPKLLIYMGSYLQSGVPSRFSGSGSGTDFTLTISSLQPEDFATYYCQQIYSFPITFGQGTKVEIKR

SEQ ID NO: 997 - protein, 108 aa, Artificial Sequence
  Description of Artificial Sequence: Synthetic polypeptide
DIQMTQSPSSLSASVGDRVTITCRASQDIEEMLHWYQQKPGKAPKLLIYFGSLLQSGVPSRFSGSRSGTDFTLTISSLQPEDFATYYCQQHHTRPYTFGQGTKVEIKR

SEQ ID NO: 998 - protein, 108 aa, Artificial Sequence
  Description of Artificial Sequence: Synthetic polypeptide
DIQMTQSPSSLSASVGDRVTITCRASQDIGMDLEWYQQIPGKVPKLLIYDASYLQSGVPSRFSGSGSGTDFTLTISSLQPEDFATYYCQQYHKLPATFGQGTKVEIKR

SEQ ID NO: 999 - protein, 108 aa, Artificial Sequence
  Description of Artificial Sequence: Synthetic polypeptide
DIQMTQSPSSLSASVGDRVTITCRASQDIMDNLEWYQQKPGKAPKLLIYAASWLQSGVPSRFSGSGSGTDFTLTISSLQPEDFATYYCQQYHKLPVTFGQGTKVEIKR

SEQ ID NO: 1000 - protein, 108 aa, Artificial Sequence
  Description of Artificial Sequence: Synthetic polypeptide
DIQMTQSPSSLSASVGDRVTITCRASQNIGEDLEWYQQKPGNAPKLLIYSASHLQSGVPSRFSGSGSGTDFTLTISSLQPEDFATYYCQQYSSYPVTFGQGTKVEIKR

SEQ ID NO: 1001 - protein, 108 aa, Artificial Sequence
  Description of Artificial Sequence: Synthetic polypeptide
DIQMTQSPSSLSASVGDRVTITCRASQPIDEDLEWYQQKPGNAPKLLIYSASYLQSGVPSRFSGSGSGTDFTLTISRLQPEDFATYYCQQYHLLPATFGQGTKVEIKR

SEQ ID NO: 1002 - protein, 108 aa, Artificial Sequence
  Description of Artificial Sequence: Synthetic polypeptide
DIQMIQSPSSLSASVGDRVTITCRASQDINEDLEWYQQKPGKAPKLLIYNASMLQSGVPSRFSGSGSGTDFTLTISSLQPKDFATYYCQQYHTNPTTFGQGTKVEIKR

SEQ ID NO: 1003 - protein, 108 aa, Artificial Sequence
  Description of Artificial Sequence: Synthetic polypeptide
DIQMTQSPSSLSASVGDRVTITCRASQDIEADLEWYQQKPGKAPKLLIYHSSELQSGVPSRFSGSGSGTDFTLTISSLQPEDFATYYCQQYHMSPVTFGQGTKVEIKR

SEQ ID NO: 1004 - protein, 108 aa, Artificial Sequence
  Description of Artificial Sequence: Synthetic polypeptide
DIQMTQSPSSLSASVGDRVTITCRASQDIDSDLEWYQQKPGKAPMLLIYSSSDLQSGVPSRFSGSGSGTDFTLTISSLQPEDFATYYCQQYHSLPVTFGQGTKVEIKR

SEQ ID NO: 1005 - protein, 108 aa, Artificial Sequence
  Description of Artificial Sequence: Synthetic polypeptide
DIQMTQSPSSLSASVGDRVTITCRASQDISDDLEWYQQKPGKAPKLLIYNSSFLQSGVPSRFSGSGSGADFTLTISSLQPEDFATYYCQQYHSLPVTFGQGTKVEIKR

SEQ ID NO: 1006 - protein, 108 aa, Artificial Sequence
  Description of Artificial Sequence: Synthetic polypeptide
DIQMTQSPSSLSASVGDRVTITCRASQDIEGNLEWYQQKPGKAPKLLIYDSSQLQSGVPSRFSGSGSGTDFTLTISSLQPEDFATYYCQQYHHLPTTFGQGTKVEIKR

SEQ ID NO: 1007 - protein, 108 aa, Artificial Sequence
  Description of Artificial Sequence: Synthetic polypeptide
DIQMTQSPSSLSASVGDRVTITCRASQSIDTDLEWYQQKPGKAPKLLIYDGSWLQSGVPSRFSGSGSGTDFTLTISSLQPEDFATYYCQQYRWIPVTFGQGTKVEIKR

SEQ ID NO: 1008 - protein, 108 aa, Artificial Sequence
  Description of Artificial Sequence: Synthetic polypeptide
DIQMTQSPSSLSASVGDRVTITCRASQSISTDLEWYQQKLGKAPKLLIYDASLLQSGVPSRFSGSGSGTDFTLTISSLQPEDFATYYCQQYSSLPVTFGQGTKVEIKR

SEQ ID NO: 1009 - protein, 108 aa, Artificial Sequence
  Description of Artificial Sequence: Synthetic polypeptide
DIQMTQSPSSLSASVGDRVTITCRASQPITTSLEWYQQKPGKAPKLLIYDASMLQSGVPSRFSGSGSGTDFTLTISSLQPEDFATYYCQQYWVTPVTFGQGTKVEIKR

SEQ ID NO: 1010 - protein, 108 aa, Artificial Sequence
  Description of Artificial Sequence: Synthetic polypeptide
DIQMTQSPSSLSASVGDRVTITCRASQNIHTNLEWYQQKPGKAPKLLIYDGSMLQSGVPSRFSGSGSGTDFTLTISSLQPEDFATYYCQQYSANPVTFGQGTKVGIKR

SEQ ID NO: 1011 - protein, 108 aa, Artificial Sequence
  Description of Artificial Sequence: Synthetic polypeptide
DIQMTQSPSSLSASVGDRVTITCRASQWIHTDLEWYQQKPGKAPKLLIYDGSMLQSGVPSRFSGSGSGTDFTLTISSLQPEDFATYYCQQYSVSPVTFGQGTKVEIKR

SEQ ID NO: 1012 - protein, 108 aa, Artificial Sequence
  Description of Artificial Sequence: Synthetic polypeptide
DIQMTQSPSSLSASVGDRVTITCRASQSIDNNLEWYQQKPGEAPKLLIYDGSLLQSGVPSRFSGSGSGTDFTLTISSLQPEDFATYYCQQYHLHPVTFGQGTKVEIKR

SEQ ID NO: 1013 - protein, 108 aa, Artificial Sequence
  Description of Artificial Sequence: Synthetic polypeptide
DIQMTQSPSSLSASVGDRVTITCRASQDIDTNLEWYQQKPGEAPKLLIYDRSTLQSGVPSRFSGSGSGTDFTLTISSLQPEDFATYYCQQYDSYPVTFGQGTKVEIKR

SEQ ID NO: 1014 - protein, 108 aa, Artificial Sequence
  Description of Artificial Sequence: Synthetic polypeptide
DIQMTQSPSSLSASVGDRVTITCRASQSIESNLEWYQQKPGKAPKLLIYNASELQSGVPSRFSGSGSGTDFTLTISSLRPEDFATYYCQQYDQWPTTFGQGTKVEIKR

SEQ ID NO: 1015 - protein, 108 aa, Artificial Sequence
  Description of Artificial Sequence: Synthetic polypeptide
DIQMTQSPSSLSASVGDRVTITCRASQAIGNTLRWYQQKPGKAPKLLIYLSSRLQSGVPSRFSGSGSGTDFTLTISSLQPEDFATYYCQQLKKPPYTFGQGTKVEIKR

SEQ ID NO: 1016 - protein, 108 aa, Artificial Sequence
  Description of Artificial Sequence: Synthetic polypeptide
DIQMTQSPSSLSASVGDRVTITCRASQKIKNRLAWYQQKPGKAPKLLIYEVSHLQSGVPSRFSGSGSGTDFTLTIGSLQPEDFATYYCQQRRQSPYTFGQGTKVEIKR

SEQ ID NO: 1017 - protein, 108 aa, Artificial Sequence
  Description of Artificial Sequence: Synthetic polypeptide
DIQMTQSPSSLSASVGDRVTITCRASEDIGEELFWYQQKPGKAPKLLIYSASTLQSEVPSRFSGSGSGTDFTLTISSLQHEDFATYYCQQVYEWPYTFGQGTKVEIKR

SEQ ID NO: 1018 - protein, 108 aa, Artificial Sequence
  Description of Artificial Sequence: Synthetic polypeptide
DIQMTQSPSSLSASVGDRVTITCRASQPISGGLRWYQQKPGKAPKLLIYSTSMLQSGVPSRFSGSGSGTDFTLTISSLQPEDFATYYCQQLYSAPYTFGQGTKVEIKR

SEQ ID NO: 1019 - protein, 108 aa, Artificial Sequence
  Description of Artificial Sequence: Synthetic polypeptide
DIQMTQSPSSLSASVGDRVTITCRASQDIDQDLEWYQQKPGKAPKLLIYNVSLLQSGVPSRFSGSGSGTDFTLTISSLQPEDFATYYCQQYSMNPVTFGQGTKVEIKR

SEQ ID NO: 1020 - protein, 108 aa, Artificial Sequence
  Description of Artificial Sequence: Synthetic polypeptide
DIQMTQSPSSLSASVGDRVTITCRASQDIGNQLKWYQQKPGKAPKLLIYQASGLQSGVPSRFSGSGSGTDFTLTISSLQPEDFATYYCQQYDLRPQTFGQGTKVEIKR

SEQ ID NO: 1021 - protein, 108 aa, Artificial Sequence
  Description of Artificial Sequence: Synthetic polypeptide
DIQMTQSPSFLSASVGDRVTITCRASQKISTSLEWYQQKPGKAPRLLIYDSSWLQSGVPSRFSGSGSGTDFTLTISSLQPEDFATYYCQQYEYNPITFGQGTKVEIKR

SEQ ID NO: 1022 - protein, 108 aa, Artificial Sequence
  Description of Artificial Sequence: Synthetic polypeptide
DIQMTQSPSSLSASVGDRVTITCRASQTIGESLHWYQQKPGKAPRLLIYFASLLQSGVPSRFSGSGSGTDFTLTISSLQPEDFATYYCQQHHMLPSTFGQGTKVEIKR

SEQ ID NO: 1023 - protein, 108 aa, Artificial Sequence
  Description of Artificial Sequence: Synthetic polypeptide
DIQMTQSPSSLSASVGDRVTITCRASQFIGDSLSWYQQKPGKAPKLLIYFSSILQSGVPSRFSGSGSGTDFTLTISSLQPEDFATYYCQQYMDIPITFGQGTKVEIKR

SEQ ID NO: 1024 - protein, 108 aa, Artificial Sequence
  Description of Artificial Sequence: Synthetic polypeptide
DIQMTQSPSSLSASVGDRVTITCRASQDIDHNLEWYQQKPGKAPKLLIYDSSMLQSGVPSRFSGSGSGTDFTLTISSLQPEDFATYYCQQYHSIPVTFGQGTKVEIKR

SEQ ID NO: 1025 - protein, 108 aa, Artificial Sequence
  Description of Artificial Sequence: Synthetic polypeptide
DIQMTQSPSSLSASVGDRVTITCRASQQIETNLEWYQQKPGKAPKLLIYDGSWLQSGVPSRFSGSGSGTDFTLTISSLQPEDFATYYCQQYHSLPATFGQGTKVEIKR

SEQ ID NO: 1026 - protein, 108 aa, Artificial Sequence
  Description of Artificial Sequence: Synthetic polypeptide
DIQMTQSPSSLSASVGDRVTITCRASQDIGNNLEWYQQKPGKAPRLLIYHGSWLQSGVPSRFSGSGSGTDFTLTISSLQPEDFATYYCQQYDFNPTTFGQGTKVEIKR

SEQ ID NO: 1027 - protein, 108 aa, Artificial Sequence
  Description of Artificial Sequence: Synthetic polypeptide
DIQMTQSPSSLSASVGDCVTITCRASQNIDGLLWWYQQKPGKAPKLLIYAGSGLQSGVPSRFSGSGSGTDFTLTISSLQPEDFATYYCQQKAFEPFTFGQGTKVEIKR

SEQ ID NO: 1028 - protein, 108 aa, Artificial Sequence
  Description of Artificial Sequence: Synthetic polypeptide
DIQMTQTPSSLSASVGDRVTITCRASQSIGHDLEWYQQKPGKAPKLLIYNVSWLQSGVPSRFSGSGSGTDFTLTISSLQPEDFATYYCQQYSHNPPTFGQGTKVEIKR

SEQ ID NO: 1029 - protein, 108 aa, Artificial Sequence
  Description of Artificial Sequence: Synthetic polypeptide
DIQMTQSPSSLSASVGDRVTITCRASQHIENDLEWYQQKPGKAPKLLIYSASHLQSGVPSRFSGSGSGTDFTLTISSLQPEDFATYYCQQYHLQPTTFGPGTKVEIKR

SEQ ID NO: 1030 - protein, 108 aa, Artificial Sequence
  Description of Artificial Sequence: Synthetic polypeptide
DIQMTQSPSSLSASVGDRVTITCRASQVIEGSLNWYQQKPGKAPKLLIYHRSILQSGVPSRFSGRGSGTDFTLTISSLQPEDFATYYCQQTYQLPLTFGQGTKVEIKR

SEQ ID NO: 1031 - protein, 108 aa, Artificial Sequence
  Description of Artificial Sequence: Synthetic polypeptide
DIQMTQSPSSLSASVGDRVTITCRASRPINGKLFWYQQKPGKAPKLLIAFASALQSGVPSRFSGSGSGTDFTLTISSLQPEDFATYYCVQQAVYPITFGQGTKVEIKR

SEQ ID NO: 1032 - protein, 108 aa, Artificial Sequence
  Description of Artificial Sequence: Synthetic polypeptide
DIQMTQSPSSLSASVGDRVTITCRASQAIETNLEWYQQKPGKAPKLLIYDGSLLQSGVPSRFSGRGSGTDFTLTISSLQPEDFATYYCQQYHYQPATFGQGTKVEIKR

SEQ ID NO: 1033 - protein, 108 aa, Artificial Sequence
  Description of Artificial Sequence: Synthetic polypeptide
DIQMTQSPSSLSASVGDRVTITCRASQDIEHDLEWYQQKPGKAPKLLIYSASQLQSGVPSRFSGSGSGTDFTLTISSLQPEDFATYYCQQYQQQPTTFGQGTKVEIKR

SEQ ID NO: 1034 - protein, 108 aa, Artificial Sequence
  Description of Artificial Sequence: Synthetic polypeptide
DIQMTQSPSSLSASVGDRVTITCRASSQIEESLWWYQQKPGKAPKLLIADVSLLQSGVPSRFSGSGSGTDFTLTISSLQPEDFATYYCAQGVVEPRTFGQGTKVEIKR

SEQ ID NO: 1035 - protein, 108 aa, Artificial Sequence
  Description of Artificial Sequence: Synthetic polypeptide
DIQMTQSPSSLSASVGDRVTITCRASQYIGLDLEWYQQKPGKAPKLLIYAASWLQSGVPSRFSGSGSGTDFTLTISSLQPEDFATYYCQQYFRQPITFGQGTKVEIKR

SEQ ID NO: 1036 - protein, 108 aa, Artificial Sequence
  Description of Artificial Sequence: Synthetic polypeptide
DIQMTQSPSSLSASVGDRVTITCRASTPIGTMLDWYQQKPGKAPKLLIGHSSWLQSGVPSRFSGSGSGTDFTLTISSLQPEDFATYYCGQHVRPPATFGQGTKVEIKR

SEQ ID NO: 1037 - protein, 108 aa, Artificial Sequence
  Description of Artificial Sequence: Synthetic polypeptide
DIQLTQSPTSLSATVGDRVTITCRASTPIGTMLDWYQQKPGKAPKLLIGHSSWLQSGVPSRFSGSGSGTDFTLTISSLQPEDFATYYCGQHVRHPATFGQGTKVEIKR

SEQ ID NO: 1038 - protein, 108 aa, Artificial Sequence
  Description of Artificial Sequence: Synthetic polypeptide
DIQMTQSPSSLSASVGDRVTITCRASTPIGTMLDWYQQKPGKAPKLLIGHSSWLQSGVPSRFSGSGSGTDFTLTISSLQPEDFATYYCGQHVRPPATFGQGTKVGIKR

SEQ ID NO: 1039 - protein, 108 aa, Artificial Sequence
  Description of Artificial Sequence: Synthetic polypeptide
DIQMTQSPSSLSASVGDRVTITCRVSTPIGTMLDWYQQKPGKAPKLLIGHSSWLQSGVPPRFSGSGSGTDFTLTISSLQPEDFATYYCGQHVRPPATFGQGTKVEIKR

SEQ ID NO: 1040 - protein, 108 aa, Artificial Sequence
  Description of Artificial Sequence: Synthetic polypeptide
DIQMTQSPSSLSASVGDRVTITCRASTPIGTMLDWYQQKPGKAPKLLIGHSSWLQSGVPSRFSGCGSGTDFTLTISSLQPEDFATYYCGQHVRPPATFGQGTKVEIKR

SEQ ID NO: 1041 - protein, 108 aa, Artificial Sequence
  Description of Artificial Sequence: Synthetic polypeptide
DIQMTQSPSSLSASVGDRVTITCRASTPIGTMIDWYQQKPGKAPKLLIGHSSWLQSGVPSRFSGSGSGTDFTLTISSLQPEDFATYYCGQHVRPPATFGKGTKVEIKR

SEQ ID NO: 1042 - protein, 108 aa, Artificial Sequence
  Description of Artificial Sequence: Synthetic polypeptide
DIQMTQSPSSLSASVGDRVTITCRASQYIDTNLEWYQQKPGKAPRLLIYDGSQLQSGVPSRFSGSGSGTDFTLIISSLQPEDFATYYCQQYQVVPVTFGQGTKVEIKR

SEQ ID NO: 1043 - protein, 108 aa, Artificial Sequence
  Description of Artificial Sequence: Synthetic polypeptide
DIQMTQSPSSLSASVGDRVTITCRASQSISSYLNWYQQKPGKAPRLLIVDSSGLQSGVPSRFSGSGSGTDFTLTISSLQPEDFATYYCGQDRWSPATFGQGTKVEIKR

SEQ ID NO: 1044 - protein, 108 aa, Artificial Sequence
  Description of Artificial Sequence: Synthetic polypeptide
DIQMTQSPSSLSASVGDRVTITCRASSRIQHMLSWYQQKPGKAPKLLIGGHSGLQSGVPSRFSGSGSGTDFTLTISSLQPEDFATYYCAQSCAWPLTFGQGTKVEIKR

SEQ ID NO: 1045 - protein, 108 aa, Artificial Sequence
  Description of Artificial Sequence: Synthetic polypeptide
DIQMTQSPSSLSASVGDRVTITCRASRGIDGDLWWYQQKPGKAPKLLIADSSLLQSGVPSRFSGSGSGTDFTLTISSLQPEDFATYYCGQGAVRPMTFGQGTKVEIKR

SEQ ID NO: 1046 - protein, 108 aa, Artificial Sequence
  Description of Artificial Sequence: Synthetic polypeptide
DIQMTQSPSSLSASVGDRVTITCRASRGIDTDLWWYQQKPGKAPKLLIADSSLLQSGVPSRFSGSGSGTDFTLTISSLQPEDFATYYCGQGAVRPMTFGQGTKVEIKR

SEQ ID NO: 1047 - protein, 108 aa, Artificial Sequence
  Description of Artificial Sequence: Synthetic polypeptide
DIQMTQSPSSLSASVGDRVTITCRASYTIPVALDWYQQKPGKAPKLLIADASLLQSGVPSRFSGSGSGTDFTLTISSLQPEDFATYYCAQGWPGPQTFGQGTKVEIKR

SEQ ID NO: 1048 - protein, 108 aa, Artificial Sequence
  Description of Artificial Sequence: Synthetic polypeptide
DIQMTQSPSSLSASVGDRVTITCRASQSIATDLEWYQQKPGKAPKLLIYDTSMLQSGVPSRFSGSGSGTDFTLTISSLQPEDFATYYCQQYSYNPSTFGQGTKVEIKR

SEQ ID NO: 1049 - protein, 108 aa, Artificial Sequence
  Description of Artificial Sequence: Synthetic polypeptide
DIQMTQSPSSLSASVGDRVTITCRASVPITEGLSWYQQKPGKAPKLLIQANSWLQSGVPSRFSGSGSGTDFTLTISSLQPEDFATYYCGQWEHVPATFGQGTKVEIKR

SEQ ID NO: 1050 - protein, 108 aa, Artificial Sequence
  Description of Artificial Sequence: Synthetic polypeptide
DIQMTQSPSSLSASVGDRVTITCRASSMILYGLDWYQQKPGKAPKLLIGGTSALQSGVPSRFSGSGSGTDFTLTISSLQPEDFATYYCGQWETVPATFGQGTKVEIKR

SEQ ID NO: 1051 - protein, 108 aa, Artificial Sequence
  Description of Artificial Sequence: Synthetic polypeptide
DIQMTQSPSSLSASVGDRVTITCRASQPINGLLIWYQQKPGKAPKLLIYAMSSLQSGVPSRFSGSGSGTDFTLTISSLQPEDFATYYCQQLARIPFTFGQGTKVGIKR

SEQ ID NO: 1052 - protein, 108 aa, Artificial Sequence
  Description of Artificial Sequence: Synthetic polypeptide
DIQMTQSPSSLSASVGDRVTITCRASQLIRTYLAWYQQKPGKAPKLLIYQSSQLQSGVPSRFSGSGSGTDFTLTISSLQPEDFATYYCQQYNSYPDTFGQGTKVEIKR

SEQ ID NO: 1053 - protein, 108 aa, Artificial Sequence
  Description of Artificial Sequence: Synthetic polypeptide
DIQMTQSPSSLSASVGDRVTITCRASQWIGDSLSWYQQKPGKAPKLLIYFGSYLQSGVPSRFSGSGSGTDFTLTISSLQPEDFATYYCQQYLHTPSTFGQGTKVEIKR

SEQ ID NO: 1054 - protein, 108 aa, Artificial Sequence
  Description of Artificial Sequence: Synthetic polypeptide
DIQMTQSPSSLSASVGDRVTITCRASQDIEADLEWYQQKPGKAPKLLIYHSSELQSGVPSRFSGSGSGTDFTLTISSLQPEDFATYYCQQYGFNPPTFGQGTKVEIKR

SEQ ID NO: 1055 - protein, 108 aa, Artificial Sequence
  Description of Artificial Sequence: Synthetic polypeptide
DIQMTQSPSSLSASVGDRVTITCRASSPIEYGLDWYQQKPGKAPKLLIGGGSALQSGVPSRFSGSGSGTDFTLTISSLQPEDFATYYCGQWEVQPATFGQGTKVEIKR

SEQ ID NO: 1056 - protein, 108 aa, Artificial Sequence
  Description of Artificial Sequence: Synthetic polypeptide
DIQMTQSPSSLSASVGDRVTITCRASQRIDTDLEWYQQKPGKAPKLLIYDSSQLQSGVPSRFSGSGSGTDFTLTISSLQPEDFATYYCQQYHSAPATFGQGTKVEIKR

SEQ ID NO: 1057 - protein, 108 aa, Artificial Sequence
  Description of Artificial Sequence: Synthetic polypeptide
DIQMTQSPSSLSASVGDRVTITCRASGWIGMSLEWHQQKPGKAPKLLIRGASSLQSGVPSRFSGSGSGTDFTLTISSLQPEDFATYYCSQSRWPPVTFGQGTKVEIKR

SEQ ID NO: 1058 - protein, 108 aa, Artificial Sequence
  Description of Artificial Sequence: Synthetic polypeptide
DIQMTQSPSSLSASVGDRVTITCRASRNISNALSWYQQKPGKAPKLLILGASWLQSGVPSRFSGSGSGTDFTLTISSLQPEDFATYYCTQVWDRPFTFGQGTKVEIKR

SEQ ID NO: 1059 - protein, 108 aa, Artificial Sequence
  Description of Artificial Sequence: Synthetic polypeptide
DIQMTQSPSSLSASVGDRVTITCRASQDIMSALSWYQQKPGKAPKLLIYSTSILQSGVPSRFSGSGSGTDFTLTISSLQPEDFATYYCQQVYLLPVTFGQGTKVEIKR

SEQ ID NO: 1060 - protein, 108 aa, Artificial Sequence
  Description of Artificial Sequence: Synthetic polypeptide
DIQMTQSPSSLSASVGDRVTITCRASQEIGIDLEWYQQKPGKAPKLLIYAASYLQSGVPSRFSSSGSGTDFTLTISSLQPEDFATYYCQQYASNPPTFGRGTKVEIKR

SEQ ID NO: 1061 - protein, 108 aa, Artificial Sequence
  Description of Artificial Sequence: Synthetic polypeptide
DIQMTQSPSSLSASVGDRVTITCRASQMIGDWLNWYQQKPGKAPKLLIYRSSELQSGVPSRFSGSGSGTDFTLTISSLQPEDFATYYCQQLYFWPRTFGQGTKVEIKR

SEQ ID NO: 1062 - protein, 108 aa, Artificial Sequence
  Description of Artificial Sequence: Synthetic polypeptide
DIQMTQSPSSLSASVGDRVTITCRASQAIELNLEWYQQKPGKAPKLLIYDASMLQSGVPSRFSGSGSGTDFTLTISSLQPEDFATYYCQQYDVYPPTFGQGTKVEIKR

SEQ ID NO: 1063 - protein, 108 aa, Artificial Sequence
  Description of Artificial Sequence: Synthetic polypeptide
DIQMTQSPSSLSASVGDRVTITCRASQAIEHNLEWYQQKPGKAPKLLIYDASMLQSGVPSRFSGSGSGTDFTLTISSLQPEDLATYYCQQYDAYPPTYGQGTKVEIKR

SEQ ID NO: 1064 - protein, 108 aa, Artificial Sequence
  Description of Artificial Sequence: Synthetic polypeptide
DIQMTQSPSSLSASVGDRVTITCRASRAIETNLEWYQQKPGKAPKLLFYDASMLQSGVPSRFGGSGSGTDFTLTISSLQPEDFATYYCLQYDVYPPTFGQGTKVEIKR

SEQ ID NO: 1065 - protein, 108 aa, Artificial Sequence
  Description of Artificial Sequence: Synthetic polypeptide
DIQMTQSPSSLSATVGDRVTITCRASQAIETNLEWYQQKPGKAPKLLIYDASMLQSGVPSRFSGSGSGTDFTLTISSLQPEDFATYYCQQYDAYPPTFGQGTKVEIKR

SEQ ID NO: 1066 - protein, 108 aa, Artificial Sequence
  Description of Artificial Sequence: Synthetic polypeptide
DIQMTQSPSSLSASVGDRVTITCRASQAIEHNLEWYQQKPGKAPKLLIYDASMLQSGVPSRFSGRGSGTDFTLTISSLQPEDFATYYCQQYDAYPPTFGQGTKVEIKR

SEQ ID NO: 1067 - protein, 108 aa, Artificial Sequence
  Description of Artificial Sequence: Synthetic polypeptide
DIQMNQSPSSLSASVGDRVSITCRASQAIEHNLEWYQQKPGKAPKLLIYDASMLQSGVPSRFSGSGSGTDFTLTISSLQPEDFATYYCQQYDAYPPTFGQGTKVEIKR

SEQ ID NO: 1068 - protein, 108 aa, Artificial Sequence
  Description of Artificial Sequence: Synthetic polypeptide
DIQMTQSPSSLSASVGDRVTITCRASQAIESNLEWYQQKPGKAPKLLIYDASMLQSGVPSRFSGSGSGTDFTLTISSLQPEDFATYYCQQYDVYPPTFGQGTKVEIKR

SEQ ID NO: 1069 - protein, 108 aa, Artificial Sequence
  Description of Artificial Sequence: Synthetic polypeptide
DIQMTQSPSSLSASVGDRVTITCRASQAIEHNLEWYQQKPGKAPKLLIYDASMLQSGVPSRFSGSGSGTDFTLTISSLQPEDFATYYCQQYDAYPPTFGQGTKVEIKR

SEQ ID NO: 1070 - protein, 108 aa, Artificial Sequence
  Description of Artificial Sequence: Synthetic polypeptide
DIQMTQSPSSLSASVGDRVTITCRASQGIDEDLEWYQQKPGKAPRLLIYSSSWLQSGVPSRFSGSGSGTDFTLTISSLQPEDFATYYCQQYFQYPPTFGQGTKVEIKR

SEQ ID NO: 1071 - protein, 108 aa, Artificial Sequence
  Description of Artificial Sequence: Synthetic polypeptide
DIQMTQSPSSLSASVGDRVTITCRASQSIDEDLEWYQQKPGKAPRLLIYSSSWLQSGVPSRFSGSGSGTDFTLTISSLQPEDFATYYCQQYFQYPPTFGQGTKVEIKR

SEQ ID NO: 1072 - protein, 108 aa, Artificial Sequence
  Description of Artificial Sequence: Synthetic polypeptide
DIQMTQSPSSLSASVGDRVTITCRASQSIDEDLEWYQQKPGKAPRLLIYSSSWLQSGVPSRFSGSGSGTDFTLTISSLQPEDFATYYCQQYSQYPPTFGQGTKVEIKR

SEQ ID NO: 1073 - protein, 108 aa, Artificial Sequence
  Description of Artificial Sequence: Synthetic polypeptide
DIQMTQSPSSLSASVGDRVTITCRASQSIEEDLEWYQQKPGKAPRLLIYSSSWLQSGVPSRFSGSGSGTDFTLTISSLQPEDFATYYCQQYFQYPPTFGHGTKVEIKR

SEQ ID NO: 1074 - protein, 108 aa, Artificial Sequence
  Description of Artificial Sequence: Synthetic polypeptide
DIQMTQSPSSLSASVGDRVTITCRASQSIDEDLEWYQQKPGKAPRLLIYSSSWLQSGVPSRFSGSGSGTDFTLTISSLQPEDFATYFCQQYFQYPPTFGQGTKVEIKR

SEQ ID NO: 1075 - protein, 108 aa, Artificial Sequence
  Description of Artificial Sequence: Synthetic polypeptide
EIQMTQSPSSLSASVGDRVTMTCRASQSIDKDLEWYQQKPGKAPRLLIYSSSWLQRGVPSRFSGSGSGTDFTLTISSLRPEDFATYYCQQYFQYPPTLGQGTKVEIKR

SEQ ID NO: 1076 - protein, 108 aa, Artificial Sequence
  Description of Artificial Sequence: Synthetic polypeptide
DIQMTQSPSSLSASVGDRVTITCRASQSIDEDLEWYQQKPGKAPRLLIYSSSWLQSGVPSRFSGSGSGTDFTLTISGLQPEDIATYYCKQYSQYPPTFGQGTKVEIKR

SEQ ID NO: 1077 - protein, 108 aa, Artificial Sequence
  Description of Artificial Sequence: Synthetic polypeptide
DIQMTQSPPSLSASVGDRVTITCRASQSIDKDLEWYQQKPGKAPRLLIYSSSWLQRGVPSRFSGSGSGTDFTLTISSLQPEDFATYHCQQYFQYPPTFGQGTKVEIKR

SEQ ID NO: 1078 - protein, 108 aa, Artificial Sequence
  Description of Artificial Sequence: Synthetic polypeptide
DIQMTQSPSSLSASVGDRVTITCRASEYINAELAWYQQKPGKAPKLLIYGSSGLQSGVPSRFSGSGSGTDFTLTISSLQPEDFATYYCLQNAMWPITFGQGTKVEIKR

SEQ ID NO: 1079 - protein, 108 aa, Artificial Sequence
  Description of Artificial Sequence: Synthetic polypeptide
DIQMTQSPSSLSASVGDRVTITCRASLDINNGLIWYQQKPGKAPRLLILGASGLQSGVPSRFSGSGSGTDFTLTISSLQPEDFATYYCSQVRSRPFTFGQGTKVEIKR

SEQ ID NO: 1080 - protein, 108 aa, Artificial Sequence
  Description of Artificial Sequence: Synthetic polypeptide
DIQMTQSPSSLSASVGDRVTITCRASQDILSALAWYQQKPGKAPKLLIYGSSVLQSGVPSRFSGSGSGTDFTLTISSLQPEDFATYYCQQNYSLPITFGQGTKVEIKR

SEQ ID NO: 1081 - protein, 108 aa, Artificial Sequence
  Description of Artificial Sequence: Synthetic polypeptide
DIQMTQSPSSLSASVGDRVTITCRASSPIESYLRWYQQKPGKAPKLLIRYVSVLQSGVPSRFSGSGSGTDFTLTISSLQPEDFATYYCGQWFRAPVTFGQGTKVEIKR

SEQ ID NO: 1082 - protein, 108 aa, Artificial Sequence
  Description of Artificial Sequence: Synthetic polypeptide
DIQMTQSPSSLSASVGDRVTITCRVSESINAELHWYQQKPGKAPKLLISGFSGLQSGVPSRFSGSGSGTDFTLTISSLQPEDFATYYCVQFAMWPFTFGQGTKVEIKR

SEQ ID NO: 1083 - protein, 108 aa, Artificial Sequence
  Description of Artificial Sequence: Synthetic polypeptide
DIQMTQSPSSLSASVGDRVTITCRASMMIRFGLDWYQQKPGKAPKLLIGGGSSLQSGVPSRFSGSGSGTDFTLTISSLQPEDFATYYCGQHERWPATFGQGTKVEIKR

SEQ ID NO: 1084 - protein, 108 aa, Artificial Sequence
  Description of Artificial Sequence: Synthetic polypeptide
DIQMTQSPSSLSASVGDRVTITCRASQSIGTLLRWYQQKPGKAPKLLIYLTSVLQSGVPSRFSGSGSGTDFTLTISSLQPEDFATYYCQQMVYRPYTFGQGTKVEIKR

SEQ ID NO: 1085 - protein, 108 aa, Artificial Sequence
  Description of Artificial Sequence: Synthetic polypeptide
DIQMTQSPSSLSASVGDRVTITCRASQTIETNLEWYQQKPGKAPKLLIYDSSQLQSGVPSRFSGSGSGTDFTLTISSLQPEDFATYYCQQYDKVPATFGQGTKVEIKR

SEQ ID NO: 1086 - protein, 108 aa, Artificial Sequence
  Description of Artificial Sequence: Synthetic polypeptide
DIQMTQSPSSLSASVGDRVTITCRASHHIQRYLSWYQQKPGKAPKLLILWGSQLQSGVPSRFSGSGSGTDFTLTISSLQPEDFATYYCGQWWAPPPTFGQGTKVEIKR

SEQ ID NO: 1087 - protein, 108 aa, Artificial Sequence
  Description of Artificial Sequence: Synthetic polypeptide
DIQMTQSPSSLSASVGDRVTITCRASHHIQRYLSWYQQKPGKAPKLLILWGSQLQSGVPSRFSGSGSGTDFTLTISSLQPEDFATYYCGQWWAPPQTFGQGTKVEIKR

SEQ ID NO: 1088 - protein, 108 aa, Artificial Sequence
  Description of Artificial Sequence: Synthetic polypeptide
DIQMTQSPSSLSASVGDRVTITCRASHDIQRYLSWYQQKPGKAPKLLILWGSQLQSGVPSRFSGSGSGTDFTLTISSLQPEDFATYYCGQWWAPPQTFGQGTKVEIKR

SEQ ID NO: 1089 - protein, 108 aa, Artificial Sequence
  Description of Artificial Sequence: Synthetic polypeptide
DIQMTQSPSSLSASVGDRVTITCRASQYIDTNLEWYQQKPGKAPKLLIYDGSLLQSGVPSRFSGSGSGTDFTLTISSLQPEDFATYYCGQGAVVPVTFGQGTKVEIKR

SEQ ID NO: 1090 - protein, 108 aa, Artificial Sequence
  Description of Artificial Sequence: Synthetic polypeptide
DIQMTQSPSSLSASVGDRVTITCRASQDIAFDLEWYQQKPGKAPKLLIYSASMLQSGVPSRFSGSGSGSDFTLTISSLQPEDFATYYCQQYNLQPPTFGQGTKVEIKR

SEQ ID NO: 1091 - protein, 108 aa, Artificial Sequence
  Description of Artificial Sequence: Synthetic polypeptide
DIQMTQSPSSLSASVGDRVTITCRASQNIATLLRWYQQKPGKAPKLLIYAGSMLQSGVPSRFSGSGSGTDFTLTISSLQPEDFATYYCQQMWQRPYTFGQGTKVEIKR

SEQ ID NO: 1092 - protein, 108 aa, Artificial Sequence
  Description of Artificial Sequence: Synthetic polypeptide
DIQMTQSPSSLSASVGDRVTITCRASQPIVDELDWYQQKPGKAPKLLIYAASILQSGVPSRFSGSGSGTDFTLTISSLQPEDFATYYCHQWSTYPTTFGQGTKVEIKR

SEQ ID NO: 1093 - protein, 108 aa, Artificial Sequence
  Description of Artificial Sequence: Synthetic polypeptide
DIQMTQSPSSLSASVGDRVTITCRASQSISSYLNWYQQKPGKAPKLLIDGVSGLQSGVPSRFSGSGSGTDFTLTISSLQPEDFATYYCGQDWDWPRTFGQGTKVEIKR

SEQ ID NO: 1094 - protein, 108 aa, Artificial Sequence
  Description of Artificial Sequence: Synthetic polypeptide
DIQMTQSPSSLSASVGDRVTITCRASRNIRDWLRWYQQKPGKAPKLLIDWGSVLQSGVPSRFSGSGSGTDFTLTISSLQPEDFATYYCAQTWDDPLTFGQGTKVEIKR

SEQ ID NO: 1095 - protein, 108 aa, Artificial Sequence
  Description of Artificial Sequence: Synthetic polypeptide
DIQMTQSPSSLSAFVGDRVTITCRASRNIRDWLRWYQQKPGKAPKLLIDWGSELQSGVPSRFSGSGSGTDFTLTISSLQPEDFATYYCAQTWYDPLTFGHGTKVEIKR

SEQ ID NO: 1096 - protein, 108 aa, Artificial Sequence
  Description of Artificial Sequence: Synthetic polypeptide
DIQMTQSPSSLSASVGDRVTITCRASIDIHGGLTWYQQKPGKAPKLLIVGVSGLQSGVPSRFSGSGSGTDFTLTISNLQPEDFATYYCAQVWRRPFTFGQGTKVEIKR

SEQ ID NO: 1097 - protein, 108 aa, Artificial Sequence
  Description of Artificial Sequence: Synthetic polypeptide
DIQMTQSPSSLSASVGDRVTITCRASQDIGSSLSWYQQKPGKAPKLLIYASSLLQSGVPSRFSGSGSGTDFTLTISSLQPEDFATYYCQQTYALPVTFGQGTKVEIKR

SEQ ID NO: 1098 - protein, 108 aa, Artificial Sequence
  Description of Artificial Sequence: Synthetic polypeptide
DIQMTQSPSSLSASVGDRVTITCRASQQIETNLEWYQQKPGKAPKLLIYDGSWLQSGVPSRFSGSGSGTDFTLTISSLQPEDFATYYCQQYKYLPVTFGQGTKVEIKR

SEQ ID NO: 1099 - protein, 108 aa, Artificial Sequence
  Description of Artificial Sequence: Synthetic polypeptide
DIQMTQSPSSLSASVGDRVTITCRASQDIGSALRWYQQKPGKAPKLLIYLGSDLQSGVPSRFSGSGSGTDFTLTISSLQPEDFATYYCQQTQYFPTTFGQGTKVEIKR

SEQ ID NO: 1100 - protein, 108 aa, Artificial Sequence
  Description of Artificial Sequence: Synthetic polypeptide
DIQMTQSPSSLSASVGDRVTITCRASQAIYGGLRWYQQKPGKAPKLLIYGESMLQSGVPSRFSGSGSGTDFTLTISSLHPEDFATYYCQQVYHKPFTFGQGTKVEIKR

SEQ ID NO: 1101 - protein, 108 aa, Artificial Sequence
  Description of Artificial Sequence: Synthetic polypeptide
DIQMTQSPSSLSASVGDRVTITCRASQRIGVWLDWYQQKPGKAPKLLIYDGSFLQSGVPSRFSGSGSGTDFTLTISSLQPEDFATYYCQQTFSSPSTFGQGTKVEIKR

SEQ ID NO: 1102 - protein, 108 aa, Artificial Sequence
  Description of Artificial Sequence: Synthetic polypeptide
DIQMTQSPSSLSASVGDRVPITCRASQWIGDELYWYQQKPGKAPKLLIYSSSTLQSGVPSRFSGSGSGTDFTLTISSLQPEDFATYYCQQSFQFPYTFGQGTKVEIKR

SEQ ID NO: 1103 - protein, 108 aa, Artificial Sequence
  Description of Artificial Sequence: Synthetic polypeptide
DIQMTQSPSSLSASVGDRVTITCRASSNITGPLEWYQQKPGKAPKLLIPGWSTLQSGVPSRFSGSGSGTDFTLTISSLQPEDFATYYCGQVWGEPVTFGQGTKVEIKR

SEQ ID NO: 1104 - protein, 108 aa, Artificial Sequence
  Description of Artificial Sequence: Synthetic polypeptide
DIQMTQSPSSLSASIGDRVTITCRASQRIAYGLHWYQQKPGKAPRLLIGGRSGLQSGVPSRFSGSGSGTDFTLTISSLQPEDFATYYCVQPGMPPDTFGQGTKVEIKR

SEQ ID NO: 1105 - protein, 108 aa, Artificial Sequence
  Description of Artificial Sequence: Synthetic polypeptide
DIQMTQSPSSLSASVGDRVTITCRASKQIVGGLSWYQQKPGKAPKLLIGRHSGLQSGVPSRFSGSGSGTDFTLTISSLQPEDFATYYCVQGVWAPGTFGQGTKVEIKR

SEQ ID NO: 1106 - protein, 108 aa, Artificial Sequence
  Description of Artificial Sequence: Synthetic polypeptide
DIQMTQSPSSLSASVGDRVTITCRASPAIAAKLDWYQQKPGKAPKLLIGADSGLQSGVPSRFSGSGSGTDFTLTISSLQPEDFATYYCGQLWAGPPTFGQGTKVEIKR

SEQ ID NO: 1107 - protein, 108 aa, Artificial Sequence
  Description of Artificial Sequence: Synthetic polypeptide
DIQMTQSPSSLSASVGDRVTITCRASRTIADGLDWYQQKPGKAPKLLIGAYSGLQSGVPSRFSGSGSGTDFTLTISSLQPEDFATYYCGQLWEGPPTFGQGTKVEIKR

SEQ ID NO: 1108 - protein, 108 aa, Artificial Sequence
  Description of Artificial Sequence: Synthetic polypeptide
DIQMTQSPSSLSASVGDRVTITCRASQRIYGFLDWYQQKPGKAPKLLIYGVSSLQSGVPSRFSGSGSGTDFTLTISSLQPEDFATYYCQQTLAWPFTFGQGTKVEIKR

SEQ ID NO: 1109 - protein, 108 aa, Artificial Sequence
  Description of Artificial Sequence: Synthetic polypeptide
DIQMTQSPSSLSASVGDRVTITCRASQDIRDWLMWYQQKPGKAPKLLIYWGSFLQSGVPSRFSGSGSGTDFTLTISSLQPEDFATYYCQQLYDTPYTFGQGTKVEIKR

SEQ ID NO: 1110 - protein, 108 aa, Artificial Sequence
  Description of Artificial Sequence: Synthetic polypeptide
DIQMTQSPSSLSASVGDRVTITCRASQNINTGLDWYQQKPGKAPKLLIYDSSALQSGVPSRFSGSGSGTDFTLTISSLQPEDFATYYCQQTSYYPYTFGQGTKVEIKR

SEQ ID NO: 1111 - protein, 108 aa, Artificial Sequence
  Description of Artificial Sequence: Synthetic polypeptide
DIQMTQSPSSLSASVGDRVTITCRASQKIFGWLDWYQQKPGKAPKLLIYGTSKLQSGVPSRFSGSGSGTDFTLTISSLQPEDFATYYCQQVYSLPYTFGQGTKVEIKR

SEQ ID NO: 1112 - protein, 108 aa, Artificial Sequence
  Description of Artificial Sequence: Synthetic polypeptide
DIQMTQSPSSLSASVGDRVTITCRASSNIGADLDWYQQKPGKAPKLLIGGASGLQSGVPSRFSGSGSGTDFTLTISSLQPEDFATYYCGQLWNGPPTFGQGTKVEIKR

SEQ ID NO: 1113 - protein, 108 aa, Artificial Sequence
  Description of Artificial Sequence: Synthetic polypeptide
DIQMTQSPSSLSASVGDRVTITCRASSPIYDGLDWYQQKPGKAPKLLISGASWLQSGVPSRFSGSGSGTDFTLTISSLQPEDFATYYCGQLWLGPPTFGQGTKVEIKQ

SEQ ID NO: 1114 - protein, 108 aa, Artificial Sequence
  Description of Artificial Sequence: Synthetic polypeptide
DIQMTQSPSSLSASVGDRVTITCRASSRIYNGLHWYQQKPGKAPKLLIGGRSGLQSGVPSRFSGSGSGTDFTLTISSLQPEDFATYYCAQVGEAPSTFGQGTKVEIKR

SEQ ID NO: 1115 - protein, 108 aa, Artificial Sequence
  Description of Artificial Sequence: Synthetic polypeptide
DIQMTQSPSSLSASVGDRVTITCRASRFINEELDWYQQKPGKAPKLLISWSSWLQSGVPSRFSGSGSGTDFTLTISSLQPEDFATYYCVQPGGGPGTFGQGTKVEIKR

SEQ ID NO: 1116 - protein, 108 aa, Artificial Sequence
  Description of Artificial Sequence: Synthetic polypeptide
DIQMTQSPSSLSASVGDRVTITCRASRDILDELDWYQQKPGKAPRLLIGGGSGLQSGVPSRFSGSGSGTDFTLTISSLQPEDFATYYCGQLWHGPPTFGQGTKVEIKR

SEQ ID NO: 1117 - protein, 108 aa, Artificial Sequence
  Description of Artificial Sequence: Synthetic polypeptide
DIQMTQSPSSLSASVGDRVTITCRASSPIYTGLHWYQQKPGKAPKLLIGGRSGLQSGVPSRFSGSGSGTDFTLTISSLQPEDFATYYCMQVGTAPATFGQGTKVEIKR

SEQ ID NO: 1118 - protein, 108 aa, Artificial Sequence
  Description of Artificial Sequence: Synthetic polypeptide
DIRMTQSPSSLSASVGDRVTITCRASQNISRRLLWYQQKPGKAPKLLIYSSSRLQSGVPSRFGGSGSGTDFTLTISSLQPEDFATYYCQQTYSYPHTFGQGTKVEIKR

SEQ ID NO: 1119 - protein, 108 aa, Artificial Sequence
  Description of Artificial Sequence: Synthetic polypeptide
DIQMTQSPSSLSASVGDRVTITCRASSPIPQDLYWYQQKPGKAPKLLIVGISQLQSGVPSRFSGSGSGTDFTLTISSLQPEDFATYYCGQLWSAPATFGQGTKVEIKR

SEQ ID NO: 1120 - protein, 108 aa, Artificial Sequence
  Description of Artificial Sequence: Synthetic polypeptide
DIQMTQSPSSLSASVGDRVTITCRASKSIDGMLDWYQQKPGKAPKLLIPGFSGLQSGVPSRFSGSGSGTDFTLTISSLQPEDFATYYCGQSVEAPWTFGQGTKVEIKR

SEQ ID NO: 1121 - protein, 108 aa, Artificial Sequence
  Description of Artificial Sequence: Synthetic polypeptide
DIQMTQSPSSLSASVGDRVTITCRASRYIAHPLDWYQQKPGKAPKLLIPGSSVLQSGVPSRFSGSGSGTDFTLTISSLQPEDFATYYCGQSVVVPWTFGQGTKVEIKR

SEQ ID NO: 1122 - protein, 108 aa, Artificial Sequence
  Description of Artificial Sequence: Synthetic polypeptide
DIQMTQSPSSLSASVGDRVTITCRASRTIEGGLDWYQQKPGKAPKLLIMGGSGLQSGVPSRFSGSGSGTDFTLTISSLQPEDFATYYCGQLWVGPPTFGQGTKVEIKR

SEQ ID NO: 1123 - protein, 108 aa, Artificial Sequence
  Description of Artificial Sequence: Synthetic polypeptide
DIQMTQSPSSLSASVGDRVTITCRASKFIRDELYWYQQKPGKAPRLLIGGSSLLQSGVPSRFSGSGSGTDFTLTISSLQPEDFATYYCGQLWRAPATFGQGTKVEIKR

SEQ ID NO: 1124 - protein, 108 aa, Artificial Sequence
  Description of Artificial Sequence: Synthetic polypeptide
DIQMTQSPSSLSASVGDRVTITCRASKPIYGGLEWYQQKPGKAPRLLIGGGSVLQSGVPSRFSGSGSGTDFTLTISSLQPEDFATYYCGQVWGGPVTFGQGTKVEIKR

SEQ ID NO: 1125 - protein, 108 aa, Artificial Sequence
  Description of Artificial Sequence: Synthetic polypeptide
DIRMTQSPSSLSASVGDRVTITCRASRPISGCLDWYQQKPGKAPKLLIDGASGLQSGVPSRFSGSGSGTDFTLTISSLQPEDFATYYCGQWWEYPPTFGQGTKVEIKR

SEQ ID NO: 1126 - protein, 108 aa, Artificial Sequence
  Description of Artificial Sequence: Synthetic polypeptide
DIQMTQSPSSLSASVGDRVTITCRASKPIVRDLEWYQQKPGKAPKLLIHGVSTLQSGVPSRFSGSGSGTDFTLTISSLQPEDFATYYCGQLEAAPATFGQGTKVEIKR

SEQ ID NO: 1127 - protein, 108 aa, Artificial Sequence
  Description of Artificial Sequence: Synthetic polypeptide
DIQMTQSPSSLSASVGDRVTITCRASRDIGDWLYWYQQKPGKAPRLLIVWASVLQSGVPSRFSGSGSGTDFTLTISSLQPEDFATYYCAQWGTPPTTFGQGTKVEIKR

SEQ ID NO: 1128 - protein, 108 aa, Artificial Sequence
  Description of Artificial Sequence: Synthetic polypeptide
DIQMTQSPSSLSASVGDRVTITCRASNRIEYGLDWYQQKPGKAPKLLISGSSRLQSGVPSRFSSSGSGTDFTLTISSLQPEDFATYYCGQLEAAPATFGQGTKVEIKR

SEQ ID NO: 1129 - protein, 108 aa, Artificial Sequence
  Description of Artificial Sequence: Synthetic polypeptide
DIQMTQSPSSLSASVGDRVTITCRASRNIGHFLDWYQQKPGKAPKLLILGGSSLQSGVPSRFSGSGSGTDFTLTISSLQPEDFATYYCGQLVEPPATFGQGTKVEIKR

SEQ ID NO: 1130 - protein, 108 aa, Artificial Sequence
  Description of Artificial Sequence: Synthetic polypeptide
DIQMTQSPSSLSASVGDRVTITCRASSSIYSDLYWYQQKPGKAPKLLIDGWSGLQSGVPSRFSGSGSGTDFTLTISSLQPEDFATYYCGQLHRAPATFGQGTKVEIKR

SEQ ID NO: 1131 - protein, 108 aa, Artificial Sequence
  Description of Artificial Sequence: Synthetic polypeptide
DIQMTQSPSSLSASVGDRVTITCRASRFITDRLDWYQQKPGKAPKLLIGGVSGLQSGVPSRFSGSGSGTDFTLTISSLQPEDFATYYCGQSSELPWTFGQGTKVEIKR

SEQ ID NO: 1132 - protein, 108 aa, Artificial Sequence
  Description of Artificial Sequence: Synthetic polypeptide
DIQMTQSPSSLSASVGDRVTITCRASRKIGSELYWYQQKPGKAPKLLIGGRSRLQSGVPSRFSGSGSGTDFTLTISSLQPEDFATYYCGQLWEPPATFGQGTKVEIKR

SEQ ID NO: 1133 - protein, 108 aa, Artificial Sequence
  Description of Artificial Sequence: Synthetic polypeptide
DIQMTQSPSSLSASVGDRVTITCRASRNIGNGLDWYQQKPGKAPKLLIGEGSRLQSGVPSRFSGSGSGTDFTLTISSLQPEDFATYYCGQLWHTPPTFGQGTKVEIKR

SEQ ID NO: 1134 - protein, 108 aa, Artificial Sequence
  Description of Artificial Sequence: Synthetic polypeptide
DIQMTQSPSSLSASVGDRVTITCRASRNIYGWLSWYQQKPGKAPRLLIGGWSGLQSGVPSRFSGSGSGTDFTLTISSLQPEDFATYYCAQDYTLPGTFGQGTKVEIKR

SEQ ID NO: 1135 - protein, 108 aa, Artificial Sequence
  Description of Artificial Sequence: Synthetic polypeptide
DIQMTQSPSSLSASVGDRVTITCRASQDIKDWLHWYQQKPGKAPKLLIYFASGLQSGVPSRFSGSGSGTDFTLTISSLQPEDSATYYCQQHYSTPYTSGQGTKVEIKR

SEQ ID NO: 1136 - protein, 108 aa, Artificial Sequence
  Description of Artificial Sequence: Synthetic polypeptide
DIQMTQSPPSLSASVGDRVTITCRASQLISSHLDWYQQKPGKAPKLLVYDASELQSGVPSRFSGSGSGTDFTLTISSLQPEDFATYYCQQHRSLPFTFGQGTKVEIKR

SEQ ID NO: 1137 - protein, 108 aa, Artificial Sequence
  Description of Artificial Sequence: Synthetic polypeptide
DIQMTQSPSSLSASVGDRVTITCRASQWIGGALAWYQQKPGKAPRLLIYQISVLQSGIPSRFSGSGSGTDFTLTISSLQPEDFATYYCQQYIRSPFTFGQGTKVEIKR

SEQ ID NO: 1138 - protein, 108 aa, Artificial Sequence
  Description of Artificial Sequence: Synthetic polypeptide
DIQMTQSPSSLSASVGDRVTITCRASQSIGAALNWYQQKPGKAPKLLIYGLSSLQSGVPSRFSGSGSGTDFTLTISSLQPEDFATYYCQQLFRLPLTFGQGTKVEIKR

SEQ ID NO: 1139 - protein, 108 aa, Artificial Sequence
  Description of Artificial Sequence: Synthetic polypeptide
DIQMTQSPSSLSASVGDRVTITCRASQPIGGRLVWYQQKPGKAPKLLIYGSSILQSGVPSRFSGSGSGTDFTLTISSLQPEDFATYYCQQYAEAPITFGQGTKVEIKR

SEQ ID NO: 1140 - protein, 108 aa, Artificial Sequence
  Description of Artificial Sequence: Synthetic polypeptide
DIQMTQSPSSLSASVGDRVTITCRASQNIGSSLIWYQQKPGKAPTLLIYYSSKLQSGVPSRFSGSGSGTDFTLTISSLQPEDFATYYCQQSLSSPYTVGQGTKVEIKR

SEQ ID NO: 1141 - protein, 108 aa, Artificial Sequence
  Description of Artificial Sequence: Synthetic polypeptide
DIQMTQSPSSLSASVGDRVTITCRASQWIGSELAWYQQKPGKAPKLLIYWTSNLQSGVPSRFSGSGSGTDFTLTISNLQPEDFATYYCQQILETPLTFGQGTKVEIKR

SEQ ID NO: 1142 - protein, 108 aa, Artificial Sequence
  Description of Artificial Sequence: Synthetic polypeptide
DIQMTQSPSSLSASVGDRVTITCRASQKIWDALYWYQQKPGKAPKLLIYRGSILQSGVPSRFSGSGSGTDFTLTISSLQPEDFATYYCQQFYRWPHTFGQGTKVEIKR

SEQ ID NO: 1143 - protein, 108 aa, Artificial Sequence
  Description of Artificial Sequence: Synthetic polypeptide
DIQMTQSPSSLSASVGDRVTITCRASQHIEDSLRWYQQKPGKAPKLLIYYGSVLQSGVPSRFSGSGSGTDFTLTISSLQPEDFATYYCQQMYKFPITFGQGTKVEIKR

SEQ ID NO: 1144 - protein, 108 aa, Artificial Sequence
  Description of Artificial Sequence: Synthetic polypeptide
DIQTTQSPSSLSASVGDRVTITCRASQRINSSLLWYQQKPGKAPKLLIYDTSTLQSGVPSRFSGSRSGTDFTLTISSLQPEDFATYYCQQIWGSPPTFGQGTKVEIKR

SEQ ID NO: 1145 - protein, 108 aa, Artificial Sequence
  Description of Artificial Sequence: Synthetic polypeptide
DIQMTQSPSSLSASVGDRVTITCRASQSIPVGLNWYQQKPGKAPRLLIYSGSTLQSGVPSRFSGSGSGTDFTLTISSLQPEDFATYYCQQDWYYPNTFGQGTKVEIKR

SEQ ID NO: 1146 - protein, 108 aa, Artificial Sequence
  Description of Artificial Sequence: Synthetic polypeptide
DIQMTQSPSSLSASVGDRVTITCRASQPIYGWLNWYQQKPGKAPKLLIYLTSGLQSGVPSRFSGSGSGTDFTLTISSLQPEDFATYYCQQIHSSPFTFGQGTKVEIKR

SEQ ID NO: 1147 - protein, 108 aa, Artificial Sequence
  Description of Artificial Sequence: Synthetic polypeptide
DIQMTQSPSSLSASVGDRVTITCRASQFIDTSLEWYQQKPGKAPKLLIYDGSHLQSGVPSRFSGSGSGTDFTLTISSLQPEDLATYYCQQYWVLPLTFGQGTKVEIKR

SEQ ID NO: 1148 - protein, 108 aa, Artificial Sequence
  Description of Artificial Sequence: Synthetic polypeptide
DIQMTQSPSSLSASVGDRVTITCRASQDIGDALFWYQQKPGKAPKLLIYYSSMLQSGVPSRFSGGGSGTDFTLTISSLQPEDFATYYCQQRHSTPATFGQGTKVEIKR

SEQ ID NO: 1149 - protein, 108 aa, Artificial Sequence
  Description of Artificial Sequence: Synthetic polypeptide
DIQMTQSPSSLSASVGDRVTITCRASQDIDESLMWYQQKPGKAPRLLIYGVSYLQSGVPSRFSGSGSGTDFTLTISSLQPEDFATYYCQQRWKAPFTFGQGTKVEIKR

SEQ ID NO: 1150 - protein, 108 aa, Artificial Sequence
  Description of Artificial Sequence: Synthetic polypeptide
DIQMTQSPSSLSASVGDRVTITCRASQEIVEDLYWYQQKPGKAAKLLIYGASWLQSGVPSRFSGSGSGTDFTLTISSLQPEDFATYYCQQTRRRPYTFGQGTKVEIKR

SEQ ID NO: 1151 - protein, 108 aa, Artificial Sequence
  Description of Artificial Sequence: Synthetic polypeptide
DIQMTQSPASLSASVGDRVTITCRASQDIDPMLRWYQQKPGKAPKLLIYAGSILQSGVPSRFSGSGSGTDFTLTISSLQPEDFATYYCQQTLVTPYTFGQGTKVEIKR

SEQ ID NO: 1152 - protein, 108 aa, Artificial Sequence
  Description of Artificial Sequence: Synthetic polypeptide
DIQMTQSPSSLSASVGDRVTITCRASQSISDALFWYQQKPGKAPRLLIYYGSVLQSGVPSRFSGSGSGTDFTLTISSLQPEDFATYYCQQRFQEPVTFGQGTKVEIKR

SEQ ID NO: 1153 - protein, 108 aa, Artificial Sequence
  Description of Artificial Sequence: Synthetic polypeptide
DIQMTQSPSSLSASVGDRVTITCRASQQISDELNWYQQKPGKAPKLLIYAVSILQSGVPSRFSGSGSGTDFTLTISSLQPEDFATYYCQQWLSFPSTFGQGTKVEIKR

SEQ ID NO: 1154 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgagcaagtcagaatattaagcattcgttacggtggtaccagcagaaaccagggaaagcccctaggctcctgatctatcatcgttcccagttgcaaagtggggtcccatcacgtttcagtggcagtggatctgggacagatttcactctcaccatcagcagtctgcaacctgaagattttgctacgtactactgtcaacaggttaggcatcgtccttatacgttcggccaagggaccaaggtggaaatcaaacgg

SEQ ID NO: 1155 - DNA, 324 bp, Artificial Sequence
  Description of Artificial Sequence: Synthetic polynucleotide
gacatccagatgacccagtctccatcctctctgtctgcatctgtaggagaccgtgtcaccatcacttgccgggcaagtcaggctattgggcatcggttacgttggtatcagcagaaaccagggaaagcccctaagctcctgatctatcatcggtccaagttgcaaagtggggtcccatcacgtttcagtggcagtggatctgggacagatttcactctcaccatcagcagtctgcaacctgaagattttgctacgtactactgtcaacaggttgctttgtttccctatacgttcggccaagggaccaaggtggaaatcaaacgg

SEQ ID NO: 1156 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcagcatattggtcatcatttaaggtggtaccagcagaaaccagggaaagcccccaagctcctgatctatcataggtcccatttgcaaagtggggtcccatcacgtttcagtggcagtggatctgggacagatttcactctcaccatcagcagtctgcaacctgaagattctgctacgtactactgtcaacagtgggataggccgccttatacgttcggccaagggaccaaggtggaaatcaaacgg

SEQ ID NO: 1157 - DNA, 324 bp, Artificial Sequence
  Description of Artificial Sequence: Synthetic polynucleotide
gacatccagatgacccagtccccatcctccctgtctgcatctgtaggagaccgtgtcaccatcacttgccgggcaagtcaggctattgggcatcggttacgttggtatcagcagaaaccagggaaagcccctaagctcctgatctatcatcggtccaagttgcaaagtggggtcccatcacgtttcagtggcagtggatctgggacagatttcactctcaccatcagcagtctgcaacctgaagattttgctacgtactactgtcaacaggtgcgggctgtgccttatacgtttggccaagggaccaaggtggaaattaaacgg

SEQ ID NO: 1158 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcaggctattgggcatcggttacgttggtatcagcagaaaccagggaaagcccctaagctcctgatctatcatcggtccaagttgcaaagtggggtcccatcacgtttcagtggcagtggatctgggacagatttcactctcaccatcagcagtctgcaacctgaagattttgctacgtactactgtcaacaggttcgtttttctccttatacgttcggccaagggaccaaggtggaaatcaaacgg

SEQ ID NO: 1159 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcaggctattgggcatcggttacgttggtatcagcagaaaccagggaaagcccctaagctcctgatctatcatcggtccaagttgcaaagtggggtcccatcacgtttcagtggcagtggatctgggacagatttcactctcaccatcagcagtctgcaacctgaagattttgctacgtactactgtcaacagtcttatgctaggcctgtgacgttcggccaagggaccaaggtggaaatcaaacgg

SEQ ID NO: 1160 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcaaagtattaatcataggttatattggtaccagcagaaaccagggaaagcccctaagctcctgatctatcatcggtccaggttgcaaagtggggtcccatcacgtttcagtggcagtggatctgggacagatttcactctcaccatcagcagtctgcaacctgaggattttgctacgtactactgtcaacagtataaggttaggcctaatacgttcggccaagggaccaaggtggaaatcaaacgg

SEQ ID NO: 1161 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcaggctattgggcatcggttacgttggtatcagcagaaaccagggaaagcccctaagctcctgatttatcatcggtccaagttgcaaagtggggtcccatcacgtttcagtggcagtggatctgggacagatttcactctcaccatcagcagtctgcaacctgaagattttgctacgtactactgtcaacagacttattcgtctcctcatacgttcggccaagggaccaaggtggaaatcaaacgg

SEQ ID NO: 1162 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcaggctattgggcatcggttacgttggtatcagcagaaaccagggaaagcccctaagctcctgatctatcatcggtccaagttgcaaagtggggtcccatcacgtttcagtggcagtggatctgggacagatttcactctcaccatcagcagtctacaacctgaagattttgctacgtactactgtcaacagagggcggtgaggccttttacgttcggccaagggaccaaagtggaaatcaaacgg

SEQ ID NO: 1163 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcaggctattgggcatcggttacgttggtatcagcagaaaccagggaaagcccctaagctcctgatctatcatcggtccaagttgcaaagtggggtcccatcacgtttcagtggcagtggatctgggacagatttcactctcaccatcagcagtctgcaacctgaagattttgctacgtactactgtcaacagacttattatcgtcctcttacgttcggccaagggaccaaggtggaaatcaaacgg

SEQ ID NO: 1164 - DNA, 324 bp, Artificial Sequence
  Description of Artificial Sequence: Synthetic polynucleotide
gacatccagatgacccagtctccagcctccctgtctgcatctgtaggagaccgtgtcaccatcacttgccgggcaagtcaggatattgatcctatgttaaggtggtaccagcagaaaccagggaaagcccctaagctcctgatctatgcgggttccattttgcaaagtggggtcccatcacgtttcagtggcagtggatctgggacagatttcactctcaccatcagcagtctgcaacctgaagattttgctacgtactactgtcaacagactagtattaggccttatacgttcggccaagggaccaaggtggaaatcaaacgg

SEQ ID NO: 1165 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcagcctattggtcctgatttactgtggtaccagcagaaaccagggaaagcccctaagctcctgatctatcagacgtccattttgcaaagtggggtcccatcacgtttcagtggcagtggatctgggacagatttcactctcaccatcagcagtctgcaacctgaagattttgctacgtactactgtcaacagtattgggcttttcctgtgacgttcggccaagggaccaaggtggaaatcaaacgg

SEQ ID NO: 1166 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcagcctattggtcctgatatactgtggtaccagcagaaaccagggaaagcccctaagctcctgatctatcagacgtccatcttgcaaagtggggtcccatcacgtttcagtggcagtgaatctgggacagatttcactctcaccatcagcagtctgcaacctgaagattttgctacgtactactgtcaacagtattgggcttttcctgtgacgttcggccaagggaccaaggtggaaatcaaacgg

SEQ ID NO: 1167 - DNA, 324 bp, Artificial Sequence
  Description of Artificial Sequence: Synthetic polynucleotide
gacatccagataacccagtctccatcctccctgtctgcatctgtaggagaccgtgtcaccatcacttgccgggcaagtcagcctattggtcctgatttactgtggtaccagcagaaaccagggaaagcccctaagctcctgatctatcagacgtccatattgcgaagtggagtcccatcacgtttcagtggcagtgggtctgggacagatttcactctcaccatcagcagtctgcaacctgaagatcttgctacgtactactgtcaacagtattgggcttttcctgtgacgttcggccaagggaccaaggtggaaatcaaacgg

SEQ ID NO: 1168 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcagcctattggtcctgatttactgtggtaccagcagaaaccagggaaagcccctaagcttctgatctatcagacgtccattttgcgaagtggggtcccatcacgtttcagtggcagaggatctgggacagatttcactctcaccatcagcagtctgcaacctgaagattttgctacgtactactgtcaacagtattgggcttttcctgtgacgttcggccaagggaccaaggtggaaatcaaacgg

SEQ ID NO: 1169 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcaacctattggtcctgatttactgtggtaccagcagaaaccagggaaagcccctaagctcttgatctatcagacgtccattttgcgaagtggggtcccatcacgtttcagtggcagcggatctgggactgatttcactctcaccatcagcagtctgcaacctgaagattttgctacgtactactgtcaacagtattggacttttcctgtgacgttcggccaagggaccaaggtggaaatcaaacgg

SEQ ID NO: 1170 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcagcctattggtcctgatttactgtggtaccagcagaaaccagggaaagcccctaagctcctgatctatcagacgtccattttgcgaagtggggtcccatcacgtttcagtggcagtggatctgagacagatttcactctcaccatcagcaatctgcaacctgaagattttgctacgtactactgtcaacagtattgggcttttcctgtgacgttcggccaagggaccaaggtggtaatcaaacgg

SEQ ID NO: 1171 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcagcctattggtcctgatttactgtggtaccagcagaaaccagggaaagcccctaagctcctgatctatcagacgtccattttgcgaagtggggtcccatcacgtttcagtggcagtggatctgagacagatttcactctcaccatcagcaatctgcaacctgaagatcttgctacgtactactgtcaacagtattgggcttttcctgtgacgttcggcaaagggaccaaggtggtaatcaaacgg

SEQ ID NO: 1172 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcagcctattggtcctgatttactgtggtaccagcagaaaccagggaaagcccctaagctcctgatctatcagacgtccattttgcgaagtggggtcccatcacgtttcagtggcagtggatctgagacagatttcactctcaccatcagcaatctgcaacctgaagattttgctacgtactactgtcaacagtattgggcttttcctgtgacgttcggccgagggaccaaggtggtaatcaaacgg

SEQ ID NO: 1173 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgagcaagtcagcctattggtcctgatttactgtggtaccggcagaaaccagggaaagcccctaagctcctgatctatcagacgtccattttgcgaagtggtgtcccatcacgtttcagtggcagtggatctgagacagatttcactctcaccatcagcaatctgcaacctgaagattttgctacgtactactgtcaacagtattgggcttttcctgtgacgttcggccaagggaccaaggtggtaatcaaacgg

SEQ ID NO: 1174 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcagcctattggtcctgatttactgtggtaccagcagaaaccagggaaagcccctaagctcctgatctatcagacgtccattatgcgaagtggggtcccatcacgtttcagtggcagtggatctgagacagatttcactctcaccatcagcaatctgcaacctgaagattttgctacgtactactgtcaacagtattggacttttcctgtgacgttcggccaagggaccaaggtggaaatcaaacgg

SEQ ID NO: 1175 - DNA, 324 bp, Artificial Sequence
  Description of Artificial Sequence: Synthetic polynucleotide
gacatccagatgacccagtctccatcctccctgtctgcatatgtaggagaccgtgtcaccatcacttgccgggcaagtcagcctattggtcctgatttactttggtaccagcagaaaccagggaaagcccctaagctcctgatctatcagacgtccattttgcgaagtggggtcccatcacgtttcagtggcagtggatctgagacagatttcaccctcaccatcagcaatctgcaacctgaagattttgctaagtactactgtcaacagtattgggcttttcctgtgacgttcggccaagggaccaaggtggtgatcaaacgg

SEQ ID NO: 1176 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcagcctattggtcctgatttactgtggtaccagcagaaaccagggaaagcccctaagctcctgatctatcagacgtccattttgcgaagtggggtcccatcacgtttcagtggcagtggatctgagacagatttcactctcaccatcagcaatctgcaacctgtagattttgctacgtactactgtcaacagtattgggcttttcctgtgacgttcggccaagggaccaaggtagtaatcaaacgg

SEQ ID NO: 1177 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcagcctattggtcctgatttactgtggttccagcagaaaccagggaaagcccctaagctcctgatctatcagacgtccattttgcaaagtggggtcccatcacgtttcagtggcagtgaatctgggacagatttcactctcaccatcagcagtctgcaacctgaagattttgctacgtactactgtcaacagtattgggcttttcctgtgacgttcggccaagggaccaaggtggaaatcaaacgg

SEQ ID NO: 1178 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcagcctatcggtcctgatttactgtggtaccggcagaaaccagggaaagcccctaagctcctgatctatcagacgtccattttgcaaagtggggtcccatcacgtttcagtggcagtggatctgggacagatttcactctcaccatcagcagtctgcaacctgaagattttgctacgtactactgtcaacagtattggacttttcctgtgacgttcggccaagggaccaaggtggaaatcaaacgg

SEQ ID NO: 1179 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcagcctattgatcctgacttactgtggtaccagcagaaaccaggtaaagcccctaagctcctgatctatcagacgtccattttgcaaagtggggtcccatcacgtttcagtggcagtggatctgggacagttttcactctcaccatcagcagtctgcaacctgaagattttgctacgtactactgtcaacagtattgggcatttcctgtgacgttcggccaagggaccaaggtggaaatcaaacgg

SEQ ID NO: 1180 - DNA, 324 bp, Artificial Sequence
  Description of Artificial Sequence: Synthetic polynucleotide
gacatccagatgacccagtctccatcctccctgtctgcatcagtaggagaccgtgtcaccatcacttgccgggcaagtcagcctattggtcctgatttactgtggtaccagcagaagccagggaaagcccctaagctcctgatctatcagacgtccattttgcgaagtggggtcccatcacgtttcagtggcagtggatctgggacagatttcactctcaccatcagcagtctgcaacctgaagattttgctacgtactactgtcaacagtattgggcttttcctgtgacgttcggccaagggaccaaggtggaaatcaaacgg

SEQ ID NO: 1181 - DNA, 324 bp, Artificial Sequence
  Description of Artificial Sequence: Synthetic polynucleotide
gacatccagatgacccagtctccatcatccctgtctgcatctgtaggagaccgtgtcaccatcacttgccgggcaagtcagcctattgaacctgatttactgtggtaccagcagaaaccagggaaagcccctaagctcctgatctatcagacgtccattttgcaaagtggggtcccatcacgtttcagtggcagtggatctgggacagatttcactctcaccatcagcagtctgcaacctgaagattttgctacgtactactgtcaacagtattgggcttctcctgtgacgttcggccaagggaccaaggtggaaatcaaacgg

SEQ ID NO: 1182 - DNA, 324 bp, Artificial Sequence
  Description of Artificial Sequence: Synthetic polynucleotide
gacatccagatgacccagtcaccatcctccctgtctgcatctgtaggagaccgtgtcaccatcacttgccgggctagtcagcctattggtcctgatttactgtggtaccagcagaaaccagggaaagcccctaagctcctgatctatcagacgtccattttgcaaagtggggtcccatcacgtttcagcggcagtgaatccgggacagatttcactctcaccatcagcagtctgcaacctgaagatattgcaacgtactactgtcaacagtattgggcttttcctgtgacgttcggccaagggaccagggtggaaatcaaacgg

SEQ ID NO: 1183 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcagcctattggtcctgatttactgtggtaccagcagaaaccagggaaagcccctaagctcctgatctatcagacgtccattttgcaaagtggggtcccttcacgtttcagtggcagtgaatctgggacagatttcactctcaccatcagcagtctgcaacctgaagattttgctacgtactactgtcaacagtattgggcttttcctgtgacgttcggccaagggaccaaggtggaaatcaaacgg

SEQ ID NO: 1184 - DNA, 324 bp, Artificial Sequence
  Description of Artificial Sequence: Synthetic polynucleotide
gacatccagatgacccagtctccatcctccctgtctgcatctgtaggagaccgtgtcgccatcacttgccgggcaagtcagcctattggtcctgatatactgtggtaccagcagaaaccagggaaagcccctaagctcctgatctatcagacgtccattttgcgaagtggggtcccatcacgtttcagtggcagtggatctgggacagatttcactctcaccatcagcagtctgcaacctgaagattctgctacgtactactgtcaacagtattgggcttttcctgtgacgttcggtcaagggaccaaggtggaaatcaaacgg

SEQ ID NO: 1185 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcagcctattggtcctgatttactgtggtaccagcagaaaccagggaaagcccctaagctcctgatctatcagacgtccattttgcgaagtggggtcccgtcacgtttcagtggcagtggatctgtgacagatttcactctcaccatcagcagtctgcaacctgaagattttgctacgtactactgtcaacagtattgggcttttcctgtgacgttcggccaagggaccaaggtgggaatcaagcgg

SEQ ID NO: 1186 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcagcctattgatcctgatttactgtggtaccagcagaaaccagggaaagcccctaagctcctgatctatcagacgtccattttgcaaagtggggtcccatcacgtttcagtggcagtggatctaggacagatttcactctcaccatcagcagtctgcaacctgaagattttgctacgtactactgtcaacagtattgggcttttcctgtgacgttcggccaagggaccaaggtggaaatcaaacgg

SEQ ID NO: 1187 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcagcctattggtcctgatttactgtggtaccagcagaaaccagggaaagcccctaagctcctgatctatcagacgtccattttgcaaagtggggtcccatcacgtttcagtggcagtggatctgggacagatttcactctcaccatcagcggtctgcaacctgaagattttgctacgtactactgtcagcagtattgggcttttcctgtgacgttcggccaagggaccaaggtggaaatcaaacgg

SEQ ID NO: 1188 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtatgcctattggtcctgatttactgtggtaccagcagaaaccagggaaggcccctaagctcctgatctatcagacgtccattttgcgaagtggggtcccatcacgtttcagtggcagtgaatctgggacagatttcactctcaccatcagcagtctgcaacctgaagattttgctacgtactactgtcaacagtattgggcttttcctgtgacgttcggccaagggaccaaggtggaaatcaaacgg

SEQ ID NO: 1189 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcagtggattggggatacgttaacgtggtaccagcagaaactagggaaagcccctaagctcctgatctatggtggttccgagttgcaaagtggggtcccaccacgtttcagtggcagtggatctgggacagatttcactctcaccatcagcagtctgcaacctgaagattttgctacgtactactgtcaacagtgtattagtagtccttgtacgttcggccaagggaccaaggtggaaatcaaacgg

SEQ ID NO: 1190 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcagtttattggtgattctttatcttggtaccagcagaaaccagggaaagcccctaagctcctgatctatttttcttccattttgcaaagtggggtcccatcacgtttcagtggcagtggatctgggacagatttcactctcaccatcagcagtctgcaacctgaagattttgctacgtactactgtcaacagtatcatacttcgcctactacgttcggccgagggaccaaggtgaaaatcaaacgg

SEQ ID NO: 1191 - DNA, 324 bp, Artificial Sequence
  Description of Artificial Sequence: Synthetic polynucleotide
gacatccagatgacccagtctccatcctccctgtccgcatctgtaggagaccgtgtcaccatcacttgccgggcaagtcagactattgagactaatttagagtggtaccagcagaaaccagggaaagcccctaagctcctgatctatgattcttcccagttgcaaagtggggtcccatcacgtttcagtggcagtggatctgggacagattttactctcaccatcagcagtctgcaacctgaagatttagctacgtactactgtcaacagtatcatgggtatcctacgacgttcggccaagggaccaaggtggaaatcaaacgg

SEQ ID NO: 1192 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcagatgattgatcaggatttagagtggtaccagcagaaaccagggaaagcccctaagctcctgatctataatgcgtcctggttgcaaagtggggtcccatcacgtttcagcggcagtggatctgggacagatttcactctcaccatcagcagtctgcaacctgaagattttgctacgtactactgtcaacagtatcatggttatcctattacgttcggccaagggaccaaggtggaaatcaaacgg

SEQ ID NO: 1193 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcagacgatttatacttcgttaagttggtatcagcagaaaccagggaaagcccctaagctcctgatccattatggttccgtgttgcaaagtggggtcccatcacgtttcagtggcagtggatctgggacagatttcactctcaccatcagcagtctgcaacctgaagattctgctacgtactactgtcaacaggttcatcaggctcctacgacgttcggccaagggaccaaggtggaaatcaaacgg

SEQ ID NO: 1194 - DNA, 324 bp, Artificial Sequence
  Description of Artificial Sequence: Synthetic polynucleotide
gacatccggatgacccagtctccatcctccctgtctgcatctgtaggagaccgtgtcaccatcacttgccgggcaagtcagtggattggggattctttagcgtggtaccagcagaagccagggaaagcccctaagctcctgatctatggtatttccgagttgcaaagtggggtcccatcacgtttcagtggcagtggatctgggacagatttcactctcaccatcagcagtctgcaacctgaagattctgctacgtactactgtcaactgtctagtagtatgcctcatacgttcggccaagggaccaaggtggaaatcaaacgg

SEQ ID NO: 1195 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcaggagattgagacgaatttagagtggtaccagcagaaaccagggaaagcccctaagctcctgatctatgattcgtcccatttgcaaagtggggtcccatcacgtttcagtggcagtggatctgggacagatttcactctcaccatcagcagtctgcaacctgaagattttgctacgtactactgtcaacagtatcatcagaatcctccgacgttcggccaaggaaccaaggtggaaatcaaacgg

SEQ ID NO: 1196 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcagtggattgggaggcagttagtttggtaccagcagaaaccagggaaagcccctaagctcctgatctatggggcgaccgagttgcaaagtggggtcccatcacgttttagtggcagtggatctgggacagatttcactctcaccatcagcagtctgcaacctgaagattttgctacgtactactgtcaacagcagtcgaagggtcctcttacgttcggccatgggaccaaggtggaaatcaaacgg

SEQ ID NO: 1197 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcaggggattggtactgatttaaattggtatcagcagaaaccagggaaagcccctaagctcctgatctatatgggttcctatttgcaaagtggggtcccatcacgtttcagtggcagtggatctgggacagatttcactctcaccatcagcagtctgcaacctgaagattttgctacgtactactgtcaacagatttattcttttcctattacgttcggccaagggaccaaggtggaaatcaaacgg

SEQ ID NO: 1198 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcaggatattgaggagatgttacattggtatcagcagaaaccagggaaagcccctaagctcctgatctattttggttccctgttgcaaagtggggtcccatcacgtttcagtggcagtagatctgggacagatttcactctcaccatcagcagtctgcaacctgaagattttgctacgtactactgtcaacagcatcatactcgtccttatacgttcggccaagggaccaaggtggaaatcaaacgg

SEQ ID NO: 1199 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcaggatattgggatggatttagagtggtaccagcagataccagggaaagtccctaagctcctgatctatgatgcgtcctatttgcaaagtggggtcccatcacgtttcagtggcagtggatctgggacagatttcactctcaccatcagcagtctgcaacctgaagattttgctacgtactactgtcaacagtatcataagcttcctgcgacgtttggccaagggaccaaggtggaaatcaaacgg

SEQ ID NO: 1200 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcaggatattatggataatttagagtggtatcagcagaaaccagggaaagcccctaagctcctgatctatgcggcgtcctggttgcaaagtggggtcccatcacgtttcagtggcagtggatctgggacagatttcactctcaccatcagcagtctgcaacctgaagattttgctacgtactactgtcaacagtatcataagttgcctgtgacgttcggccaagggaccaaggtggaaatcaaacgg

SEQ ID NO: 1201 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgagcaagtcagaatattggggaggatttagagtggtaccagcagaaaccagggaatgcccctaagctcctgatctatagtgcgtcccatttgcaaagtggggtcccatcacgtttcagtggcagtggatctgggacagatttcactctcaccatcagcagtctgcaacctgaagattttgctacgtactactgtcaacagtattctagttatcctgttacgttcggccaagggaccaaggtggaaatcaaacgg

SEQ ID NO: 1202 - DNA, 324 bp, Artificial Sequence
  Description of Artificial Sequence: Synthetic polynucleotide
gacatccagatgacccagtctccatcctccctgtctgcatccgtaggagaccgtgtcaccatcacttgccgggcaagtcagccgattgatgaggatttagagtggtaccagcagaaaccagggaatgcccctaagctcctgatctatagtgcgtcctatttgcaaagtggggtcccatcacgtttcagtggcagtggatctgggacagatttcactctcaccatcagcagactgcaacctgaagattttgctacgtactactgtcaacagtatcatcttctgcctgctacgttcggccaagggaccaaggtggaaatcaaacgg

SEQ ID NO: 1203 - DNA, 324 bp, Artificial Sequence
  Description of Artificial Sequence: Synthetic polynucleotide
gacatccagatgatccagtctccatcctccctgtctgcatctgtaggagaccgtgtcaccatcacttgccgggcaagtcaggatattaatgaggatttagagtggtatcagcagaaaccagggaaagcccctaagctcctgatctataatgcttccatgttgcaaagcggggtcccatcacgtttcagtggcagtggatctgggacagatttcactctcaccatcagcagtctgcaacctaaagattttgctacgtactactgtcaacagtatcatactaatcctactacgttcggccaagggaccaaggtggaaatcaaacgg

SEQ ID NO: 1204 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcaggatattgaggcggatttagagtggtaccagcagaaaccagggaaagcccctaagctcctgatctatcattcttccgagttgcaaagtggggtcccatcacgtttcagtggaagtggatctgggacagatttcactctcaccatcagcagtctgcaacctgaagattttgctacgtactactgtcaacagtatcatatgtcgcctgtgacgttcggccaagggaccaaggtggaaatcaaacgg

SEQ ID NO: 1205 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcaggatattgatagtgatttagagtggtaccagcagaaaccagggaaagcccctatgctcctgatctattcttcgtccgatttgcaaagtggggtcccatcacgtttcagtggcagtggatctgggacagatttcactctcaccatcagcagtctgcaacctgaagattttgctacgtactactgtcaacagtatcatagtctgcctgttacgttcggccaagggaccaaggtggaaatcaaacgg

SEQ ID NO: 1206 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcaggatatttcggatgatttagagtggtaccagcagaaaccagggaaagcccctaagctcctgatctataattcgtcctttttgcaaagtggggtcccatcacgtttcagtggcagtggatctggggcagatttcactctcaccatcagcagtctgcaacctgaagattttgctacgtactactgtcaacagtatcatagtttgcctgttacgttcggccaagggaccaaggtggaaatcaaacgg

SEQ ID NO: 1207 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcaggatattgagggtaatttagagtggtaccagcagaaaccagggaaagcccctaagctcctgatctatgattcgtcccagttgcaaagtggggtcccatcacgtttcagtggcagtgggtctgggacagatttcactctcaccatcagcagtctgcaacctgaagattttgctacgtactactgtcaacagtatcatcatcttcctacgacgttcggccaagggaccaaggtggaaatcaaacgg

SEQ ID NO: 1208 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcagagtattgatacggatttagagtggtatcagcagaaaccagggaaagcccctaagctcctgatctatgatgggtcctggttgcaaagtggggtcccatcacgtttcagtggcagtggatctgggacagattttactctcaccatcagcagtctgcaacctgaagattttgctacgtactactgtcaacagtatcggtggattcctgttacgttcggccaagggaccaaggtggaaatcaaacgg

SEQ ID NO: 1209 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcagagtattagtactgatttagagtggtaccagcagaaactagggaaagcccctaagctcctgatctatgatgcttcccttttgcaaagtggggtcccatcacgtttcagtggcagtggatctgggacagatttcactctcaccatcagcagtctgcaacctgaagattttgctacgtactactgtcaacagtattcgagtctgcctgttacgttcggccaagggaccaaggtggaaatcaaacgg

SEQ ID NO: 1210 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcagcctattacgacgtctttagagtggtaccagcagaaaccagggaaagcccctaagctcctgatctatgatgcgtccatgttgcaaagtggggtcccatcacgtttcagtggcagtggatctgggacagatttcactctcaccatcagcagtctgcaacctgaagattttgctacgtactactgtcaacagtattgggttacgcctgttacgttcggccaagggaccaaggtggaaatcaaacgg

SEQ ID NO: 1211 - DNA, 324 bp, Artificial Sequence
  Description of Artificial Sequence: Synthetic polynucleotide
gacatccagatgacccagtctccatcctccctgtctgcatctgtaggagaccgtgtcaccatcacctgccgggcaagtcagaatattcatacgaatttagagtggtatcagcagaaaccagggaaagcccctaagctcctgatctatgatggttccatgttgcaaagtggggtcccatcacgtttcagtggcagtggatctgggacagatttcactctcaccatcagcagtctgcaacctgaagattttgctacgtactactgtcaacagtattcggctaatcctgttacgttcggccaagggaccaaggtgggaatcaaacgg

SEQ ID NO: 1212 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcagtggattcatacggatttagagtggtatcagcagaaaccagggaaagcccctaagctcctgatctatgatggttccatgttgcaaagtggggtcccatcacgtttcagtggcagtggatctgggacagatttcactctcaccatcagcagtctgcaacctgaagattttgctacgtactactgtcaacagtatagtgtgtcgcctgttacgttcggccaagggaccaaggtggaaatcaaacgg

SEQ ID NO: 1213 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcagagtattgataataatttagagtggtaccagcagaaaccaggggaagcccctaagctcctgatctatgatgggtcccttttgcaaagtggggtcccatcacgtttcagtggcagtggatctgggacagatttcactcttaccatcagcagtctgcaacctgaagattttgctacgtactactgtcaacagtatcatcttcatcctgttacgttcggccaagggaccaaggtggaaatcaaacgg

SEQ ID NO: 1214 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcaggatattgatacgaatttagagtggtatcagcagaaaccaggggaagcccctaagctcctgatctatgatcgttccacgttgcaaagtggggtcccatcacgtttcagtggcagtggatctgggacagatttcactctcaccatcagcagtctgcaacctgaagattttgctacgtactactgtcaacagtatgattcttatcctgtgacgttcggccaagggaccaaggtggaaatcaaacgg

SEQ ID NO: 1215 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcagtctattgagtctaatttagagtggtaccagcagaaaccagggaaagcccctaagctcctgatctataatgcgtccgagttgcaaagtggggtcccatcacgtttcagtggcagtggatctgggacagatttcactctcaccatcagcagtctgcgacctgaagattttgctacgtactactgtcaacagtatgatcagtggcctacgacgttcggccaagggaccaaggtggaaatcaaacgg

SEQ ID NO: 1216 - DNA, 324 bp, Artificial Sequence
  Description of Artificial Sequence: Synthetic polynucleotide
gacatccagatgacccagtctccatcctccctgtctgcatctgtaggagaccgtgtcactatcacttgccgggcaagtcaggctattggtaatactttacggtggtaccagcagaaaccagggaaagcccctaagctcctgatctatcttagttccaggttgcaaagtggggtcccatcacgtttcagtggcagtggatctgggacagattttactctcaccatcagcagtctgcaacctgaagattttgctacgtactactgtcaacagctgaagaagcctccttatacgttcggccaagggaccaaggtggaaatcaaacgg

SEQ ID NO: 1217 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcagaagattaagaatcggttagcgtggtaccagcagaaaccagggaaagcccctaagctcctgatctatgaggtttcccatttgcaaagtggggtcccatcacgtttcagtggcagtggatctgggacagatttcactctcaccatcggcagtctgcaacctgaagattttgctacgtactactgtcaacagaggaggcagtcgccttatacgttcggccaagggaccaaggtggaaatcaaacgg

SEQ ID NO: 1218 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtgaggatattggggaggagttattttggtatcagcagaaaccagggaaagcccctaagctcctgatctattcggcgtccacgttgcaaagtgaggtcccatcacgtttcagtggcagtggatctgggacagatttcactctcaccatcagcagtctgcaacatgaagattttgctacgtactactgtcaacaggtttatgagtggccttatacgttcggccaagggaccaaggtggaaatcaaacgg

SEQ ID NO: 1219 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcagcctatttctgggggtttaaggtggtaccagcagaaaccagggaaagcccctaagctcctgatctattctacttccatgttgcaaagtggggtcccatcacgtttcagtggcagtggatctgggacagatttcactctcaccatcagcagtctgcaacctgaagattttgctacgtactactgtcaacagctttattctgctccttatacgttcggccaagggaccaaggtggaaatcaaacgg

SEQ ID NO: 1220 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcaggatattgatcaggatttagagtggtaccagcagaaaccagggaaagcccctaagctcctgatctataatgtttccctgttgcaaagtggggtcccatcacgtttcagtggcagtggatctgggacagatttcactctcaccatcagcagtctgcaacctgaagattttgctacgtactactgtcaacagtattctatgaatcctgttacgttcggccaagggaccaaggtggaaatcaaacgg

SEQ ID NO: 1221 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcaggatattgggaatcagttaaagtggtaccagcagaaaccagggaaagcccctaagctcctgatctatcaggcttccgggttgcaaagtggggtcccatcacgtttcagtggcagtggatctgggacagatttcactctcaccatcagcagtctgcaacctgaagattttgctacgtactactgtcaacagtatgatttgaggcctcagacgttcggccaagggaccaaggtggaaatcaaacgg

SEQ ID NO: 1222 - DNA, 324 bp, Artificial Sequence
  Description of Artificial Sequence: Synthetic polynucleotide
gacatccagatgacccagtctccatccttcctgtctgcatctgtaggtgaccgtgtcaccatcacttgccgggcgagtcagaagatttctacgtctttagagtggtatcagcagaaaccagggaaagcccctaggctcctgatctatgattcttcctggttgcaaagtggggtcccatcacgtttcagtggcagtggatctgggacagatttcactctcaccattagcagtctgcaacctgaagattttgctacgtactactgtcaacagtatgagtataatcctattacgttcggccaagggaccaaggtggaaatcaaacgg

SEQ ID NO: 1223 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcagacgattggggagagtttacattggtaccagcagaaaccagggaaagcccctaggctcctgatctattttgcttccctgttgcaaagtggggtcccatcgcgtttcagtggcagtggatctgggacagattttactctcaccatcagcagtctgcaacctgaagattttgctacgtactactgtcaacagcatcatatgcttccttctacgttcggccaagggaccaaggtggaaatcaaacgg

SEQ ID NO: 1224 - DNA, 324 bp, Artificial Sequence
  Description of Artificial Sequence: Synthetic polynucleotide
gacatccaaatgacccagtctccatcctccctgtctgcatctgtaggagaccgtgtcaccatcacttgccgggcaagtcagtttattggtgattctttatcttggtaccagcagaaaccagggaaagcccctaagctcctgatctatttttcttccattttgcaaagtggggtcccatcacgtttcagtggcagtggatctgggacagatttcactctcaccatcagcagtctgcaacctgaagattttgctacgtactactgtcaacagtatatggatattcctattacgttcggccaagggaccaaggtggaaatcaaacgg

SEQ ID NO: 1225 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcaggatattgatcataatttagagtggtatcagcagaaaccagggaaagcccctaagctcctgatctatgatagttccatgttgcaaagtggggtcccatcacgtttcagtggcagtggatctgggacagatttcactctcaccatcagcagtctgcaacctgaagattttgctacgtactactgtcaacagtatcattctattcctgttacgttcggccaagggaccaaggtggaaatcaaacgg

SEQ ID NO: 1226 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcagcagattgagacgaatttagagtggtatcagcagaaaccagggaaagcccctaagctcctgatctatgatggttcctggttgcaaagtggggtcccatcacgtttcagtggcagtggatctgggacagatttcactctcaccatcagcagtctgcaacctgaagattttgctacgtactactgtcaacagtatcatagtttgcctgctacgttcggccaagggaccaaggtggaaatcaaacgg

SEQ ID NO: 1227 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcaggatattggtaataatttagagtggtaccagcagaaaccagggaaagcccctaggctcctgatctatcatgggtcctggttgcaaagtggggtcccatcgcgtttcagtggcagtggatctgggacagatttcactcttaccatcagcagtctgcaacctgaagattttgctacgtactactgtcaacagtatgattttaatcctactacgttcggccaagggaccaaggtggaaatcaaacgg

SEQ ID NO: 1228 - DNA, 324 bp, Artificial Sequence
  Description of Artificial Sequence: Synthetic polynucleotide
gacatccagatgacccagtctccatcctccctgtctgcatctgtaggagactgtgtcaccatcacttgccgggcaagtcagaatattgatggtctgttatggtggtatcagcagaaaccagggaaagcccctaagctcctgatctatgcggggtccgggttgcaaagtggggtcccatcacgtttcagtggcagtggatctgggacagatttcactctcaccatcagcagtctgcaacctgaagattttgctacgtactactgtcaacagaaggcttttgagccttttacgttcggccaagggaccaaggtggaaatcaaacgg

SEQ ID NO: 1229 - DNA, 324 bp, Artificial Sequence
  Description of Artificial Sequence: Synthetic polynucleotide
gacatccagatgacccagactccatcctccctgtctgcatctgtaggagaccgtgtcaccatcacttgccgggcaagtcagagtattggtcatgatttagagtggtaccagcagaaaccagggaaagcccctaagctcctgatctataatgtgtcctggttgcaaagtggggtcccatcacgtttcagtggcagtggatctgggacagattttactctcaccatcagcagtctgcaacctgaagattttgctacgtactactgtcaacagtatagtcataatcctcctacgttcggccaagggaccaaggtggaaatcaaacgg

SEQ ID NO: 1230 - DNA, 324 bp, Artificial Sequence
  Description of Artificial Sequence: Synthetic polynucleotide
gacatccagatgacccagtctccatcctccctgtctgcatctgtaggagaccgtgtcactatcacttgccgggcaagtcagcatattgagaatgatttagagtggtaccagcagaaaccagggaaagcccctaagctcctgatctattctgcttcccatttgcaaagtggggtcccatcacgtttcagtggcagtggatctgggacagatttcactctcaccatcagcagtctgcaacctgaagattttgctacgtactactgtcaacagtatcatcttcagcctacgacgttcggcccagggaccaaggtggaaatcaaacgg

SEQ ID NO: 1231 - DNA, 324 bp, Artificial Sequence
  Description of Artificial Sequence: Synthetic polynucleotide
gacatccagatgacccagtctccatcctccctgtctgcatctgtaggagaccgtgtcactatcacttgccgggcaagtcaggttattgagggtagtttaaattggtaccagcagaaaccagggaaagcccctaagctcctgatctatcataggtccattttgcaaagtggggtcccatcacgtttcagtggccgtggatctgggacagatttcactctcaccatcagcagtctgcaacctgaagattttgctacgtactactgtcaacagacttatcagcttcctttgacgttcggccaagggaccaaggtggaaatcaaacgg

SEQ ID NO: 1232 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcgtcctattaatggtaagttattttggtaccagcagaaaccaggcaaagcccctaagctcctgatcgcgtttgcttccgctttgcaaagtggggtcccatcacgtttcagtggcagtggatctgggacagatttcactctcaccatcagcagtctgcaacctgaagattttgctacgtactactgtgtgcagcaggctgtgtatcctattacgttcggccaagggaccaaggtggaaatcaaacgg

SEQ ID NO: 1233 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcaggctattgagacgaatttagagtggtatcagcagaaaccagggaaagcccctaagctcctgatctatgatgggtcccttttgcaaagtggggtcccatcacgtttcagtggcagaggatctgggacagatttcactctcaccatcagcagtctgcaacctgaagattttgctacgtactactgtcaacagtatcattatcagcctgcgacgttcggccaagggaccaaggtggaaatcaaacgg

SEQ ID NO: 1234 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcaggatattgagcatgatttagagtggtaccagcagaaaccagggaaagcccctaagctcctgatctattcggcgtcccagttgcaaagtggggtcccatcacgtttcagtggcagtggatctgggacagatttcactctcaccatcagcagtctgcaacctgaagattttgctacgtactactgtcaacagtatcagcagcagcctactacgttcggccaagggaccaaggtggaaatcaaacgg

SEQ ID NO: 1235 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagttcgcagattgaggagtctttatggtggtaccagcagaaaccagggaaagcccctaagctcctgatcgcggatgtttccctgttgcaaagtggagtcccatcacgtttcagtggcagtggatctgggacagatttcactctcaccatcagcagtctgcaacctgaagattttgctacgtactactgtgctcagggtgtggtggagcctcgtacgttcggccaagggaccaaggtggaaatcaaacgg

SEQ ID NO: 1236 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcagtatattggtctggatttagagtggtatcagcagaaaccagggaaagcccctaagctcctgatctatgctgcttcctggttgcaaagtggggtcccatcacgtttcagtggcagtggatctgggacagatttcactctcaccatcagcagtctgcaacctgaagattttgctacgtactactgtcaacagtattttcggcagcctattacgttcggccaagggaccaaggtggaaatcaaacgg

SEQ ID NO: 1237 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtacgccgattggtactatgttagattggtaccagcagaaaccagggaaagcccctaagctcctgatcgggcattcgtcctggttgcaaagtggggtcccatcacgtttcagtggcagtggatctgggacagatttcactctcaccatcagcagtctgcaacctgaagattttgctacgtactactgtgggcagcatgtgcgtcctcctgcgacgttcggccaagggaccaaggtggaaatcaaacgg

SEQ ID NO: 1238 - DNA, 324 bp, Artificial Sequence
  Description of Artificial Sequence: Synthetic polynucleotide
gacatccagttgacccagtctccaacctccctgtctgcaactgtaggagaccgtgtcaccatcacttgccgggcaagtacgccgattggtactatgttagattggtaccagcagaaacctgggaaagcccctaagctcctgatcgggcattcgtcctggttgcaaagtggggtcccatcacgtttcagtggcagtggatctgggactgatttcactctcaccatcagcagtctgcaacctgaagattttgctacgtactactgtgggcagcatgtgcgtcatcctgcgacgttcggccaagggaccaaggtggaaatcaagcgg

SEQ ID NO: 1239 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtacgccgattggtactatgttagattggtaccagcagaaaccagggaaagcccctaagctcctgatcgggcattcgtcctggttgcaaagtggggtcccatcacgtttcagtggcagtggatctgggacagatttcactctcaccatcagcagtctgcaacctgaagattttgctacgtactactgtggacagcatgtgcgtcctcctgcgacgttcggccaagggaccaaggtgggaatcaaacgg

SEQ ID NO: 1240 - DNA, 324 bp, Artificial Sequence
  Description of Artificial Sequence: Synthetic polynucleotide
gacatccagatgacccagtctccgtcctccctgtctgcatctgtaggagaccgtgtcaccatcacttgccgggtaagtacgccgattggtactatgttagattggtaccagcagaaaccagggaaagcccctaagctcctgatcgggcattcgtcctggttgcaaagtggggtcccaccacgtttcagtggcagcggatctgggacagatttcactctcaccatcagcagtctgcaacctgaagattttgctacgtactactgtgggcagcatgtgcgtcctcctgcgacgttcggccaagggaccaaggtggaaatcaaacgg

SEQ ID NO: 1241 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtacgccgattggtactatgttagattggtaccagcagaaaccagggaaagcccctaagctcctgatcgggcattcgtcctggttgcaaagtggggtcccatcacgtttcagtggctgtggatctgggacagatttcactctcaccatcagcagtctgcaacctgaagattttgctacgtactactgtgggcagcatgtgcgtcctcctgcgacgttcggccaagggaccaaggtggaaatcaaacgg

SEQ ID NO: 1242 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtacgccgattggtactatgatagattggtaccagcagaaaccagggaaagcccctaagctcctgatcgggcattcgtcctggttgcaaagtggggtcccatcacgtttcagtggcagtggatctgggacagatttcactctcaccatcagcagtctgcaacctgaagattttgctacgtactactgtgggcagcatgtgcgtcctcctgcgacgttcggcaaagggaccaaggtggaaatcaaacgg

SEQ ID NO: 1243 - DNA, 324 bp, Artificial Sequence
  Description of Artificial Sequence: Synthetic polynucleotide
gacatccagatgacccagtctccatcctccctgtctgcatctgtaggagaccgtgtcaccatcacatgccgggcaagtcagtatattgatactaatttagagtggtaccagcagaaaccagggaaagcccctaggctcctgatctatgatggttcccagttgcaaagtggggtcccatcacgtttcagtggcagtggatctgggacagatttcactctcatcatcagcagtctgcaacctgaagattttgctacgtactactgtcaacagtatcaggttgtgcctgttacgttcggccaagggaccaaggtggaaatcaaacgg

SEQ ID NO: 1244 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcagagcattagcagctatttaaattggtaccagcagaaaccagggaaagcccctaggctcctgatcgtggattcttccgggttgcaaagtggggtcccatcacgtttcagtggcagtggatctgggacagatttcactctcaccatcagcagtctgcaacctgaagattttgctacgtactactgtggtcaggatcgttggtctcctgctacgttcggccaagggaccaaggtggaaatcaaacgg

SEQ ID NO: 1245 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagttcgcggattcagcatatgttatcttggtaccagcagaaaccagggaaagcccctaagctcctgatcggtgggcattccgggttgcaaagtggggtcccatcacgtttcagtggcagtggatctgggacagatttcactctcaccatcagcagtctgcaacctgaagattttgctacgtactactgtgcgcaatcgtgtgcgtggcctctgacgttcggccaagggaccaaggtggaaatcaaacgg

SEQ ID NO: 1246 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtaggggtattgatggtgatttatggtggtaccagcagaaaccagggaaagcccctaagctcctgatcgcggattcttccctgttgcaaagtggggtcccatcacgtttcagtggcagtggatctgggacagatttcactctcaccatcagcagtctgcaacctgaagattttgctacgtactactgtgggcagggggctgttcggcctatgacgttcggccaagggaccaaggtggaaatcaaacgg

SEQ ID NO: 1247 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtaggggtattgatactgatttatggtggtaccagcagaaaccagggaaagcccctaagctcctgatcgcggattcttccctgttgcaaagtggggtcccatcacgtttcagtggcagtggatctgggacagatttcactctcaccatcagcagtctgcaacctgaagattttgctacgtactactgtgggcagggggctgttcggcctatgacgttcggccaagggaccaaggtggaaatcaaacgg

SEQ ID NO: 1248 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagttatactattccggttgctttagattggtaccagcagaaaccagggaaagcccctaagctcctgatcgctgatgcgtccttgttgcaaagtggggtcccatcacgtttcagtggcagtggatctgggacagatttcactctcaccatcagcagtctgcaacctgaagattttgctacgtactactgtgcgcagggttggccggggcctcagacgttcggccaagggaccaaggtggaaatcaaacgg

SEQ ID NO: 1249 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcagagtattgcgacggacttagagtggtatcagcagaaaccagggaaagcccctaagctcctgatctatgatacttccatgttgcaaagcggggtcccatcacgtttcagtggcagtggatctgggacagatttcactctcaccatcagcagtctgcaacctgaagattttgctacgtactactgtcaacagtatagttataatccttcgacgttcggccaagggaccaaggtggaaatcaaacgg

SEQ ID NO: 1250 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtgtgcctattactgagggtttatcgtggtaccagcagaaaccagggaaagcccctaagctcctgatccaggctaattcctggttgcaaagtggggtcccatcacgtttcagtggcagtggatctgggacagatttcactctcaccatcagcagtctgcaacctgaagattttgctacgtactactgtgggcagtgggagcatgttcctgcgacgttcggccaagggaccaaggtggaaatcaaacgg

SEQ ID NO: 1251 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtagtatgattctttatggtttagattggtaccagcagaaaccagggaaagcccctaagctcctgatcggtggtacttccgcgttgcaaagtggggtcccatcacgtttcagtggcagtggatctgggacagatttcactctcaccatcagcagtctgcaacctgaagattttgctacgtactactgtgggcagtgggagacggttcctgctacgttcggccaagggaccaaggtggaaatcaaacgg

SEQ ID NO: 1252 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcagcctattaatgggcttttaatttggtatcagcagaaaccagggaaagcccctaagctcctgatctatgcgatgtccagtttgcaaagtggggtcccatcacgtttcagtggcagtggatctgggacagatttcactctcaccatcagcagtctgcaacctgaagattttgctacgtactactgtcaacagttggctcggattccttttacgttcggccaagggaccaaggtgggaatcaaacgg

SEQ ID NO: 1253 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgagcaagtcagctgattcggacttatttagcgtggtaccagcagaaaccagggaaagcccctaagctcctgatctatcagtcttctcagttgcaaagtggtgtcccatcacgtttcagtggcagtggatctgggacagatttcactctcaccatcagcagtctgcaacctgaagattttgctacgtactactgtcaacagtataattcttatcctgatacgttcggccaagggaccaaggtggaaatcaaacgg

SEQ ID NO: 1254 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcagtggattggggattcgttaagttggtaccagcagaaaccagggaaagcccctaagctcctgatctattttggttcctatttgcaaagtggggtcccatcacgtttcagtggcagtggatctgggacagatttcactctcaccatcagcagtctgcaacctgaagattttgctacgtactactgtcaacagtatttgcatactccttcgacgttcggccaagggaccaaggtggaaatcaaacgg

SEQ ID NO: 1255 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcaggatattgaggcggatttagagtggtaccagcagaaaccagggaaagcccctaagctcctgatctatcattcttccgagttgcaaagtggggtcccatcacgtttcagtggcagtggatctgggacagatttcactctcaccatcagcagtctgcaacctgaagattttgctacgtactactgtcaacagtatggttttaatcctcctacgttcggccaagggaccaaggtggaaatcaaacgg

SEQ ID NO: 1256 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagttctcctattgagtatggtttagattggtaccagcagaaaccagggaaagcccctaagctcctgatcgggggggggtccgcgttgcaaagtggggtcccatcacgtttcagtggcagtggatctgggacagatttcactctcaccatcagcagtctgcaacctgaagattttgctacgtactactgtgggcagtgggaggttcagcctgctacgttcggccaagggaccaaggtggaaatcaaacgg

SEQ ID NO: 1257 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcagcggattgatactgatttagagtggtaccagcagaaaccagggaaagcccctaagctcctgatctatgatagttcacagttgcaaagtggggtcccatcacgtttcagtggcagtggatctgggacagatttcactctcaccatcagcagtctgcaacctgaagattttgctacgtactactgtcaacagtatcatagtgcgcctgcgacgttcggccaagggaccaaggtggaaatcaaacgg

SEQ ID NO: 1258 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtgggtggattggtatgtctttagagtggcaccagcagaaaccagggaaagcccctaagctcctgatccgtggggcttcctctttgcaaagtggggtcccatcacgtttcagtggcagtggatctgggacagatttcactctcaccatcagcagtctgcaacctgaagattttgctacgtactactgtagtcagtctcggtggccgcctgtgacgttcggccaagggaccaaggtggaaatcaaacgg

SEQ ID NO: 1259 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcgtaatatttcgaatgctttatcgtggtaccagcagaaaccagggaaagcccctaagctcctgatccttggggcttcctggttgcaaagtggggtcccatcacgtttcagtggcagtggatctgggacagatttcactctcaccatcagcagtctgcaacctgaagattttgctacgtactactgtactcaggtgtgggataggccttttacgttcggccaagggaccaaggtggaaatcaaacgg

SEQ ID NO: 1260 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcaggatattatgtcggctttatcttggtatcagcagaaaccagggaaagcccctaagctcctgatctattctacttccattttgcaaagtggggtcccatcacgtttcagtggcagtggatctgggacagatttcactctcaccatcagcagtctgcaacctgaagattttgctacgtactactgtcaacaggtttatttgctgcctgttacgttcggccaagggaccaaggtggaaatcaaacgg

SEQ ID NO: 1261 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcaggagattgggattgatttagagtggtatcagcagaaaccagggaaagcccctaagctcctgatctatgctgcttcttatttgcaaagtggggtcccatcacgtttcagtagcagtggatctgggacagatttcactctcaccatcagcagtctgcaacctgaagattttgctacgtactactgtcaacagtatgcttctaatcctcctacgttcggccgagggaccaaggtggaaatcaaacgg

SEQ ID NO: 1262 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcagatgattggggattggttaaattggtaccagcagaaaccagggaaagcccctaaactcctgatctatcgtagttccgagttgcaaagtggggtcccatcacgtttcagtggcagtggatctgggacagatttcactctcaccatcagcagtctgcaacctgaagattttgctacgtactactgtcaacagttgtatttttggcctcgtacgttcggccaagggaccaaggtggaaatcaaacgg

SEQ ID NO: 1263 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcaggcgattgagcttaatttagagtggtaccagcagaaaccagggaaggcccctaagctcctgatctatgatgcttccatgttgcaaagcggggtcccatcacgtttcagtggcagtggatctgggacagatttcactctcaccattagcagtctgcaacctgaagattttgctacgtactactgtcaacagtatgatgtttatcctcctacgttcggccaagggaccaaggtggaaatcaaacgg

SEQ ID NO: 1264 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggccagtcaggcgattgagcataatttagagtggtaccagcagaagccagggaaggcccctaagctcctgatctatgatgcttccatgttgcaaagcggggtcccatcacgtttcagtggcagtggatctgggacagatttcactctcaccattagcagtctccaacctgaagatttagctacgtactactgtcaacagtatgatgcttatcctcctacgtacggccaagggaccaaggtggaaatcaaacgg

SEQ ID NO: 1265 - DNA, 324 bp, Artificial Sequence
  Description of Artificial Sequence: Synthetic polynucleotide
gacatccagatgacacagtctccatcctccctgtccgcatctgtaggagaccgtgtcaccatcacttgccgggcaagtcgggcgatagagactaatttagagtggtaccagcagaaaccagggaaggcccctaagctcctgttctatgatgcttccatgttgcaaagcggggtcccatcacgtttcggtggcagtggatctgggacagatttcactctcaccattagcagtctgcaacctgaagattttgctacgtactactgtctacagtatgatgtttatcctcctacgttcggccaagggaccaaggtggaaatcaaacgg

SEQ ID NO: 1266 - DNA, 324 bp, Artificial Sequence
  Description of Artificial Sequence: Synthetic polynucleotide
gacatccagatgacccagtctccatcctccctgtctgcaactgtaggagaccgtgtcaccatcacttgtcgtgcaagtcaggcgattgagactaatttagagtggtaccagcagaaaccagggaaggcccctaagctcctgatctatgatgcttccatgttgcaaagcggggtcccatcacgtttcagtggcagtggatctgggacagacttcactctcaccattagcagtctgcaacctgaagattttgctacgtactactgtcaacagtatgatgcttatcctcctacgttcggccaagggaccaaggtggaaatcaaacgg

SEQ ID NO: 1267 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcaggcgattgagcataacttagagtggtaccagcagaaaccagggaaggcccctaagctcctgatctatgatgcttccatgttgcaaagcggggtcccatcacgtttcagtggcagaggatctgggacagatttcactctcaccattagcagtctgcaacctgaagattttgctacgtactactgtcaacagtatgatgcttatcctcctacgttcggccaagggaccaaggtggaaatcaaacgg

SEQ ID NO: 1268 - DNA, 324 bp, Artificial Sequence
  Description of Artificial Sequence: Synthetic polynucleotide
gacatccagatgaaccagtctccatcctccctgtctgcatctgtaggagaccgtgtctccatcacttgcagggcaagtcaggctattgagcataatttagagtggtaccagcagaaaccagggaaggcccctaagctcctgatctatgatgcttccatgttgcaaagcggggtcccatcacgcttcagtggcagtggatctgggacagatttcactctcaccattagcagtctgcaacctgaagattttgctacgtactactgtcaacagtatgatgcttatcctcctacgttcggccaagggaccaaggtggaaatcaaacgg

SEQ ID NO: 1269 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcaggcgattgagtctaatttagagtggtaccagcaaaaaccagggaaggcccctaagctcctgatctatgatgcttccatgttgcaaagcggggtcccatcacgtttcagtggcagtggatctgggacagatttcactctcaccattagcagtctgcaacctgaagattttgctacgtactactgtcaacagtatgatgtttatcctcctacgttcggccaagggaccaaggtggaaatcaaacgg

SEQ ID NO: 1270 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgtgcaagtcaggcgattgagcataatttagagtggtaccagcagaaaccagggaaggcccctaagctcctgatctatgatgcttccatgttgcaaagcggggtcccatcacgtttcagtggcagtggatctgggacagatttcactctcaccattagcagtctgcaacctgaagattttgctacgtactactgtcaacagtatgatgcttatcctcctacgttcggccaagggaccaaggtggaaatcaaacgg

SEQ ID NO: 1271 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcagggtattgatgaggatttagagtggtaccagcagaaaccagggaaagcccctaggctcctgatctattctagttcctggttgcaaagtggggtcccatcacgtttcagtgggagtggatctgggacagatttcactctcaccatcagcagtctgcaacctgaagattttgctacgtactactgtcaacagtattttcagtatcctccgacgttcggccaagggaccaaggtggaaatcaaacgg

SEQ ID NO: 1272 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcagagtattgatgaggatttagagtggtaccagcagaaaccagggaaagcccctaggctcctgatctattctagttcctggttgcaaagtggggtcccatcacgtttcagtgggagtggatctgggacagatttcactctcaccatcagcagtctgcaacctgaagattttgctacgtactactgtcaacagtattttcagtatcctccgacgttcggccaagggaccaaggtggaaatcaaacgg

SEQ ID NO: 1273 - DNA, 324 bp, Artificial Sequence
  Description of Artificial Sequence: Synthetic polynucleotide
gacatccagatgacccagtctccatcctccctgtccgcatctgtaggagaccgtgtcaccatcacttgcagggcaagtcagagtattgatgaggatttagagtggtaccagcagaaaccagggaaagcccctaggctcctgatctattctagttcctggttgcaaagtggggtcccatcacgtttcagtgggagtggatctgggacagatttcactctcaccatcagcagtctgcaacctgaagattttgctacgtactactgtcaacagtattctcagtatcctccgacgttcggccaagggaccaaggtggaaatcaaacgg

SEQ ID NO: 1274 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcagagtattgaagaggatttagagtggtaccagcagaaaccagggaaagcccctaggctcctgatctattctagttcctggttgcaaagcggggtcccatcacgtttcagtgggagtggctctgggacagatttcactctcaccatcagcagtctgcaacctgaagattttgctacgtactactgtcaacagtattttcagtatcctccgacgttcggccatgggaccaaggtggaaatcaaacgg

SEQ ID NO: 1275 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcagagtattgatgaggatttagagtggtaccagcagaaaccagggaaagcccctaggctcctgatctattctagttcctggttgcaaagtggggtcccatcacgtttcagtgggagtggatctgggacagatttcactctcaccatcagcagtctgcaacctgaagattttgctacgtacttctgtcaacagtattttcagtatcctccgacgttcggccaagggaccaaggtggaaatcaaacgg

SEQ ID NO: 1276 - DNA, 324 bp, Artificial Sequence
  Description of Artificial Sequence: Synthetic polynucleotide
gagatccagatgacccagtctccatcctccctgtctgcatctgtaggagaccgtgtcaccatgacttgccgggcaagtcagagtattgataaggatttagagtggtaccagcagaaaccagggaaagcccctaggctcctgatctattctagttcctggttgcaaagaggggtcccatcacgtttcagtgggagtggatctgggacagatttcactctcaccatcagcagtctgcgacctgaagattttgctacgtactactgtcaacagtattttcagtatcctccgacgttgggccaagggaccaaggtggaaatcaaacgg

SEQ ID NO: 1277 - DNA, 324 bp, Artificial Sequence
  Description of Artificial Sequence: Synthetic polynucleotide
gacatccagatgacccagtctccatcctccctgtctgcatctgtaggagaccgagtcaccatcacttgccgggcaagtcagagtattgatgaggatttagagtggtaccagcagaaaccagggaaagcccctaggctcctgatctattctagttcctggttgcaaagtggggtcccatcacgtttcagtgggagtggatctgggacagatttcactctcaccatcagcggtctgcaacctgaagatatcgctacgtactactgtaaacagtattctcagtatcctccgacgttcggccaagggaccaaggtggaaatcaaacgg

SEQ ID NO: 1278 - DNA, 324 bp, Artificial Sequence
  Description of Artificial Sequence: Synthetic polynucleotide
gacatccagatgacccagtccccaccctccctgtctgcatctgtaggagaccgtgtcaccatcacttgccgggcaagtcagagtattgataaggatttagagtggtaccagcagaaaccagggaaagcccctaggctcctgatctattctagttcctggttgcaaagaggggtcccatcacgtttcagtgggagtggatctgggacagatttcactctcaccatcagcagtctgcaacctgaagattttgctacgtaccactgtcaacagtattttcagtatcctccgacgttcggccaagggaccaaggtggaaatcaaacgg

SEQ ID NO: 1279 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtgagtatattaatgctgagttagcttggtatcagcagaaaccagggaaagcccctaagctcctgatctatgggagttccgggttgcaaagtggggtcccatcacgtttcagtggcagtggatctgggacagatttcactctcaccatcagcagtctgcaacctgaagattttgctacgtactactgtctgcagaatgcgatgtggcctattacgttcggccaagggaccaaggtggaaatcaaacgg

SEQ ID NO: 1280 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtctggatattaataatggtttaatttggtaccagcagaaaccagggaaagcccctaggctcctgatcttgggtgcgtccggtttgcaaagtggggtcccatcacgtttcagtggcagtggatctgggacagatttcactctcaccatcagcagtctgcaacctgaagattttgctacgtactactgttcgcaggtgcgttctcggccttttacgttcggccaagggaccaaggtggaaatcaaacgg

SEQ ID NO: 1281 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcaggatattctgagtgcgttagcttggtatcagcagaaaccagggaaagcccctaagctcctgatctatgggagttccgttttgcaaagtggggtcccatcacgtttcagtggcagtggatcagggacagatttcactctcaccatcagcagtctgcaacctgaagattttgctacgtactactgtcaacagaattatagtcttcctattacgttcggccaagggaccaaggtggaaatcaaacgg

SEQ ID NO: 1282 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagttctcctattgagtcgtatttaaggtggtaccagcagaaaccagggaaagcccctaagctcctgatcaggtatgtgtccgtgttgcaaagtggggtcccatcacgtttcagtggcagtggatctgggacagatttcactctcaccatcagcagtctgcaacctgaagattttgctacgtactactgtgggcagtggtttcgggcgcctgttacgttcggccaagggaccaaggtggaaatcaaacgg

SEQ ID NO: 1283 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggtaagtgagtctattaatgctgagttacattggtaccagcagaaaccagggaaagcccctaagctcctgatctctgggttttccgggttgcaaagtggggtcccatcacgtttcagtggcagtggatctgggacagatttcactctcaccatcagcagtctgcaacctgaagattttgctacgtactactgtgtgcagtttgcgatgtggccttttacgttcggccaagggaccaaggtggaaatcaaacgg

SEQ ID NO: 1284 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtatgatgattaggtttgggttagattggtaccagcagaaaccagggaaagcccctaagctcctgatcggtggtgggtcctctttgcaaagtggggtcccatcacgtttcagtggcagtggatctgggacagatttcactctcaccatcagcagtctgcaacctgaagattttgctacgtactactgtgggcagcatgagcggtggcctgctacgttcggccaagggaccaaggtggaaatcaaacgg

SEQ ID NO: 1285 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcagagtattggtactcttttacgttggtatcagcagaaaccagggaaagcccctaagctcctgatctatcttacttccgttttgcaaagtggggtcccatcacgtttcagtggcagtggatctgggacagatttcactctcaccatcagcagtctgcaacctgaagattttgctacgtactactgtcaacagatggtttatcgtccttatacgttcggccaagggaccaaggtggaaatcaaacgg

SEQ ID NO: 1286 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcagactattgagactaatttagagtggtaccagcagaaaccagggaaagcccctaagctcctgatctatgattcttcccagttgcaaagtggggtcccatcacgtttcagtggcagtggatctgggacagatttcactctcaccatcagcagtctgcaacctgaagattttgctacgtactactgtcaacagtatgataaggttcctgcgacgttcggccaagggaccaaggtggaaatcaaacgg

SEQ ID NO: 1287 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcatcatattcagaggtatttatcgtggtaccagcagaaaccagggaaagcccctaagctcctgatcctttggggttcccagttgcaaagtggggtcccatcacgtttcagtggcagtggatctgggacagatttcactctcaccatcagcagtctgcaacctgaagattttgctacgtactactgtgggcagtggtgggctcctcctccgacgttcggccaagggaccaaggtggaaatcaaacgg

SEQ ID NO: 1288 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcatcatattcagaggtatttatcgtggtaccagcagaaaccagggaaagcccctaagctcctgatcctttggggttcccagttgcaaagtggggtcccatcacgtttcagtggcagtggatctgggacagatttcactctcaccatcagcagtctgcaacctgaagattttgctacgtactactgtgggcagtggtgggctcctcctcagacgttcggccaagggaccaaggtggaaatcaaacgg

SEQ ID NO: 1289 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcatgatattcagaggtatttatcgtggtaccagcagaaaccagggaaagcccctaagctcctgatcctttggggttcccagttgcaaagtggggtcccatcacgtttcagtggcagtggatctgggacagatttcactctcaccatcagcagtctgcaacctgaagattttgctacgtactactgtgggcagtggtgggctcctcctcagacgttcggccaagggaccaaggtggaaatcaaacgg

SEQ ID NO: 1290 - DNA, 324 bp, Artificial Sequence
  Description of Artificial Sequence: Synthetic polynucleotide
gacatccagatgacccagtctccatcctccctgtctgcatctgtaggagaccgtgtcaccatcacatgccgggcaagtcagtatattgatactaatttagagtggtaccagcagaaaccagggaaagcccctaagctcctgatctatgatggttccctgttgcaaagtggggtcccatcacgtttcagtggcagtggatctgggacagatttcactctcaccatcagcagtctgcaacctgaagattttgctacgtactactgtgggcagggggctgttgtgcctgttacgttcggccaagggaccaaggtggaaatcaaacgg

SEQ ID NO: 1291 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcaggatattgcttttgatttagagtggtatcagcagaaaccagggaaagcccctaagctcctgatctattcggcgtccatgttgcaaagtggggtcccatcacgtttcagtggcagtggatctgggtcagatttcactctcaccatcagcagtctgcaacctgaagattttgctacgtactactgtcaacagtataatcttcagcctcctacgttcggccaagggaccaaggtggaaatcaaacgg

SEQ ID NO: 1292 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcagaatattgctacgctgttacgttggtaccagcagaaaccagggaaagcccctaagctcctgatctatgctggttccatgttgcaaagtggggtcccatcacgtttcagtggcagtggatctgggacagatttcactctcaccatcagcagtctgcaacctgaagattttgctacgtactactgtcaacagatgtggcagcgtccttatacgttcggccaagggaccaaggtggaaatcaaacgg

SEQ ID NO: 1293 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcagcctattgttgatgagttagattggtaccagcagaaaccagggaaagcccctaagctcctgatctatgctgcgtccattttgcaaagtggggtcccatcacgtttcagtggcagtggatctgggacagatttcactctcaccatcagcagtctgcaacctgaagattttgctacgtactactgtcatcagtggtctacttatcctacgacgttcggccaagggaccaaggtggaaattaaacgg

SEQ ID NO: 1294 - DNA, 324 bp, Artificial Sequence
  Description of Artificial Sequence: Synthetic polynucleotide
gacatccagatgacccaatctccatcctccctgtctgcatctgtaggagaccgtgtcaccatcacttgccgggcaagtcagagcattagcagctatttaaattggtaccagcagaaaccagggaaagcccctaagctcctaatcgatggtgtttccggtttgcaaagtggggtcccatcacgtttcagtggcagtggatctgggacagatttcactctcaccatcagcagtctgcaacctgaagattttgctacgtactactgtgggcaggattgggattggcctcgtacgttcggccaagggaccaaggtggaaatcaaacgg

SEQ ID NO: 1295 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtaggaatattcgtgattggttacggtggtaccagcagaaaccagggaaagcccctaagctcctgatcgattgggggtccgtgttgcaaagtggggtcccatcacgtttcagtggcagtggatctgggacagatttcactctcaccatcagcagtctgcaacctgaagattttgctacgtactactgtgctcagacgtgggatgatcctctgacgttcggccaagggaccaaggtggaaatcaaacgg

SEQ ID NO: 1296 - DNA, 324 bp, Artificial Sequence
  Description of Artificial Sequence: Synthetic polynucleotide
gacatccagatgacccagtctccatcctccctgtctgcatttgtaggagaccgtgtcaccatcacttgccgggcaagtaggaatattcgtgattggttacggtggtaccaacagaaaccagggaaagcccctaagctcctgatcgattgggggtccgagttgcaaagtggggtcccatcacgtttcagtggcagtggatctgggacagatttcactctcaccatcagcagtctgcaacctgaagattttgctacgtactactgtgctcagacgtggtatgatcctctgacgttcggccacgggaccaaggtggaaatcaaacgg

SEQ ID NO: 1297 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtattgatattcatggtggtttaacttggtaccagcagaaaccagggaaagcccctaagctcctgatcgtgggggtttccggtttgcaaagtggggtcccatcacgtttcagtggcagtggatctgggacagatttcactctcaccatcagcaatctgcaacctgaagattttgctacgtactactgtgcgcaggtgtggcgtaggccttttacgttcggccaagggaccaaggtggaaatcaaacgg

SEQ ID NO: 1298 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcaggatattgggagttcgttatcttggtatcagcagaaaccagggaaagcccctaagctcctgatctatgcttcttccctgttgcaaagtggggtcccatcacgtttcagtggcagtggatctgggacagatttcactctcaccatcagcagtctgcaacctgaagattttgctacgtactactgtcaacagacttatgctcttcctgttacgttcggccaagggaccaaggtggaaatcaaacgg

SEQ ID NO: 1299 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcagcagattgagacgaatttagagtggtatcagcagaaaccagggaaagcccctaagctcctgatctatgatggttcctggttgcaaagtggggtcccatcacgtttcagtggcagtggatctgggacagatttcactctcaccatcagcagtctgcaacctgaagattttgctacgtactactgtcaacagtataagtatctgcctgtgacgttcggccaagggaccaaggtggaaatcaaacgg

SEQ ID NO: 1300 - DNA, 324 bp, Artificial Sequence
  Description of Artificial Sequence: Synthetic polynucleotide
gacatccagatgacccagtctccatcctccctgtctgcatctgtaggtgaccgtgtcaccatcacttgccgggcaagtcaggatattgggtctgcgttaaggtggtatcagcagaaaccagggaaagcccctaagctcctgatctatttgggttccgatttgcaaagtggggtcccatcacgtttcagtggcagtggatctgggacagatttcactctcaccatcagcagtctgcaacctgaagattttgctacgtactactgtcaacagacgcagtattttcctacgacgttcggccaagggaccaaggtggaaatcaaacgg

SEQ ID NO: 1301 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcaggcgatttatggggggttacggtggtaccagcagaaaccagggaaagcccctaagctcctgatctatggggagtccatgttgcaaagtggggtcccatcacgtttcagtggcagtggatctgggacagatttcactctcaccatcagcagtctgcatcctgaagattttgctacgtactactgtcaacaggtttatcataagccttttacgttcggccaagggaccaaggtggaaatcaaacgg

SEQ ID NO: 1302 - DNA, 324 bp, Artificial Sequence
  Description of Artificial Sequence: Synthetic polynucleotide
gacatccagatgacccagtctccatcctccctgtctgcatctgtaggagaccgtgtcaccatcacgtgccgggcaagtcagcgtattggggtgtggttagattggtatcagcagaaaccagggaaagcccctaagctcctgatctatgatggttcctttttgcaaagtggggtcccatcacgtttcagtggcagtggatctgggacagatttcactctcaccatcagcagtctgcaacctgaagattttgctacgtactactgtcaacagactttttcgagtccttctacgttcggccaagggaccaaggtggaaatcaaacgg

SEQ ID NO: 1303 - DNA, 324 bp, Artificial Sequence
  Description of Artificial Sequence: Synthetic polynucleotide
gacatccagatgacccagtctccatcctccctgtctgcatctgtaggagaccgtgtccccatcacttgccgggcaagtcagtggattggggatgagttatattggtatcagcagaaaccagggaaagcccctaagctcctgatctatagttcttccactttgcaaagtggggtcccatcacgtttcagtggcagtggatctgggacagatttcactctcaccatcagcagtctgcaacctgaagattttgctacgtactactgtcaacagtcgtttcagtttccttatacgttcggccaagggaccaaggtggaaatcaaacgg

SEQ ID NO: 1304 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtagtaatattacggggccgttagagtggtaccagcagaaaccagggaaagcccctaagctcctgatccctggttggtccactttgcaaagtggggtcccatcacgtttcagtggcagtggatctgggacagatttcactctcaccatcagcagtctgcaacctgaagattttgctacgtactactgtggtcaggtgtggggggagcctgttacgttcggccaagggaccaaggtggaaatcaaacgg

SEQ ID NO: 1305 - DNA, 324 bp, Artificial Sequence
  Description of Artificial Sequence: Synthetic polynucleotide
gacatccagatgacccagtctccatcctccctgtctgcgtctataggagaccgtgtcaccatcacttgccgggcaagtcagcgtattgcttatggtttacattggtaccagcagaaaccagggaaagcccctaggctcctgatcggggggcggtccggtttgcaaagtggggtcccatcacgtttcagtggcagtggatctgggacagatttcactctcaccatcagcagtctgcaacctgaagattttgctacgtactactgtgtgcagcctgggatgccgcctgatacgttcggccaagggaccaaggtggaaatcaaacgg

SEQ ID NO: 1306 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtaagcagattgttggtggtttatcttggtaccagcagaaaccagggaaagcccctaagctcctgatcgggcgtcattctgggttgcaaagtggggtcccatcacgtttcagtggcagtggatctgggacagatttcactctcaccatcagcagtctgcaacctgaagattttgctacgtactactgtgtgcagggggtttgggctcctgggacgttcggccaagggaccaaggtggaaatcaaacgg

SEQ ID NO: 1307 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcctgctattgctgctaagttagattggtaccagcagaaaccagggaaagcccctaagctcctgatcggtgcggattccgggttgcaaagtggggtcccatcacgtttcagtggcagtggatctgggacagatttcactctcaccatcagcagtctgcaacctgaagattttgctacgtactactgtggtcagctgtgggcggggcctccgacgttcggccaagggaccaaggtggaaatcaaacgg

SEQ ID NO: 1308 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcgtactattgctgatgggttagattggtaccagcagaaaccagggaaagcccctaagctcctgatcggggcgtattccggtttgcaaagtggggtcccatcacgtttcagtggcagtggatctgggacagatttcactctcaccatcagcagtctgcaacctgaagattttgctacgtactactgtggtcagctttgggagggtcctccgacgttcggccaagggaccaaggtggaaatcaaacgg

SEQ ID NO: 1309 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcagaggatttatgggtttttagattggtatcagcagaaaccagggaaagcccctaagctcctgatctatggggtgtcctcgttgcaaagtggggtcccatcacgttttagtggcagcggatctgggacagatttcactctcaccatcagcagtctgcaacctgaagattttgctacgtactactgtcaacagactttggcgtggccttttacgttcggccaagggaccaaggtggaaatcaaacgg

SEQ ID NO: 1310 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcaggatattcgggattggttaatgtggtaccagcagaaaccagggaaagcccctaagctcctgatctattggggttcctttttgcaaagtggggtcccatcacgtttcagtggcagtggatctgggacagatttcactctcaccatcagcagtctgcaacctgaagattttgctacgtactactgtcaacagctgtatgatactccttatacgttcggccaagggaccaaggtggaaatcaaacgg

SEQ ID NO: 1311 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcagaatattaatacgggtttagattggtatcagcagaaaccagggaaagcccctaagctcctgatctatgatagttccgctttgcaaagtggggtcccatcacgtttcagtggcagtggatctgggacagatttcactctcaccatcagcagtctgcaacctgaagattttgctacgtactactgtcaacagacgtcgtattatccttatacgttcggccaagggaccaaggtggaaatcaaacgg

SEQ ID NO: 1312 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcagaagatttttggttggttagattggtaccagcagaaaccagggaaagcccctaagctcctgatctatgggacttccaagttgcaaagtggggtcccatcacgtttcagtggcagtggatctgggacagatttcactctcaccatcagcagtctgcaacctgaagattttgctacgtactactgtcaacaggtttattcgcttccttatacgttcggccaagggaccaaggtggaaatcaaacgg

SEQ ID NO: 1313 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagttcgaatattggggcggatttagattggtaccagcagaaaccagggaaagcccctaagctcctgatcgggggggcgtccgggttgcaaagtggggtcccatcacgtttcagtggcagtggatctgggacagatttcactctcaccatcagcagtctgcaacctgaagattttgctacgtactactgtgggcagctgtggaatgggcctcctacgttcggccaagggaccaaggtggaaatcaaacgg

SEQ ID NO: 1314 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtagtccgatttatgatggtttagattggtaccagcagaaaccagggaaagcccctaagctcctgatctctggtgcttcctggttgcaaagtggggtcccatcacgcttcagtggcagtggatctgggacagatttcactctcaccatcagcagtctgcaacctgaagattttgctacgtactactgtggtcagttgtggttgggtcctccgacgttcggccaagggaccaaggtggaaatcaaacag

SEQ ID NO: 1315 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagttcgcgtatttataatggtttacattggtaccagcagaaaccagggaaagcccctaagctcctgatcggtggtcggtccgggttgcaaagtggggtcccatcacgtttcagtggcagtggatctgggacagatttcactctcaccatcagcagtctgcaacctgaagattttgctacgtactactgtgctcaggtgggggaggctccttctacgttcggccaagggaccaaggtggaaatcaaacgg

SEQ ID NO: 1316 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtaggtttattaatgaggagttagattggtaccagcagaaaccagggaaagcccctaagctcctgatctcgtggtcttcctggttgcaaagtggggtcccatcacgtttcagtggcagtggatctgggacagatttcactctcaccatcagcagtctgcaacctgaagattttgctacgtactactgtgtgcagccggggggtggtcctgggacgttcggccaagggaccaaggtggaaatcaaacgg

SEQ ID NO: 1317 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtagggatattctggatgagttagattggtaccagcagaaaccagggaaagcccctaggctcctgatcggtggggggtccgggttgcaaagtggggtcccatcacgtttcagtggcagtggatctgggacagatttcactctcaccatcagcagtctgcaacctgaagattttgctacgtactactgtggtcagctgtggcatgggcctccgacgttcggccaagggaccaaggtggaaatcaaacgg

SEQ ID NO: 1318 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtagtcctatttatacgggtttacattggtaccagcagaaaccagggaaagcccctaagctcctgatcggtgggcggtccgggttgcaaagtggggtcccatcacgtttcagtggcagtggatctgggacagatttcactctcaccatcagcagtctgcaacctgaagattttgctacgtactactgtatgcaggttgggacggctcctgctacgttcggccaagggaccaaggtggaaatcaaacgg

SEQ ID NO: 1319 - DNA, 324 bp, Artificial Sequence
  Description of Artificial Sequence: Synthetic polynucleotide
gacatccggatgacccagtctccatcctccctgtctgcatctgtaggagaccgtgtcaccatcacttgccgggcaagtcagaatatttctaggcggttactgtggtaccagcagaaaccagggaaagcccctaagctcctgatctattcttcttcccggttgcaaagtggggtcccatcacgtttcggtggcagtggatctgggacggatttcactctcaccatcagcagtctgcaacctgaagattttgctacgtactactgtcaacagacgtatagctatcctcatacgttcggccaagggaccaaggtggaaatcaaacgg

SEQ ID NO: 1320 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtagtccgattccgcaggatttatattggtaccagcagaaaccagggaaagcccctaagctcctgatcgttgggatttcccagttgcaaagtggggtcccatcacgtttcagtggcagtggatctgggacagatttcactctcaccatcagcagtctgcaacctgaagattttgctacgtactactgtgggcagttgtggagtgcgcctgctacgttcggccaagggaccaaggtggaaatcaaacgg

SEQ ID NO: 1321 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtaagtctattgatgggatgttagattggtaccagcagaaaccagggaaagcccctaagctcctgatccctggtttttccggtttgcaaagtggggtcccatcacgtttcagtggcagtggatctgggacagatttcactctcaccatcagcagtctgcaacctgaagattttgctacgtactactgtgggcagtcggttgaggcgccttggacgttcggccaagggaccaaggtggaaatcaaacgg

SEQ ID NO: 1322 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcggtatattgctcatcctttagattggtaccagcagaaaccagggaaagcccctaagctcctgatcccgggttcgtccgttttgcaaagtggggtcccatcacgtttcagtggcagtggatctgggacagatttcactctcaccatcagcagtctgcaacctgaagattttgctacgtactactgtggtcagtcggttgtggtgccttggacgttcggccaagggaccaaggtggaaatcaaacgg

SEQ ID NO: 1323 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcggacgattgagggtggtttagattggtaccagcagaaaccagggaaagcccctaagctcctgatcatggggggttccggtttgcaaagtggggtcccatcacgtttcagtggcagtggatctgggacagatttcactctcaccatcagcagtctgcaacctgaagattttgctacgtactactgtgggcagttgtgggtgggtcctcctacgttcggccaagggaccaaggtggaaatcaaacgg

SEQ ID NO: 1324 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtaagtttattagggatgagttatattggtaccagcagaaaccagggaaagcccctaggctcctgatcggtggttcgtccttgttgcaaagtggggtcccatcacgtttcagtggcagtggatctgggacagatttcactctcaccatcagcagtctgcaacctgaagattttgctacgtactactgtgggcagctgtggcgggcgcctgcgacgttcggccaagggaccaaggtggaaatcaaacgg

SEQ ID NO: 1325 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtaagccgatttatggtggtttagagtggtaccagcagaaaccagggaaagcccctaggctcctgatcggggggggttccgtgttgcaaagtggggtcccatcacgtttcagtggcagtggatctgggacagatttcactctcaccatcagcagtctgcaacctgaagattttgctacgtactactgtgggcaggtgtgggggggtcctgttacgttcggccaagggaccaaggtggaaatcaaacgg

SEQ ID NO: 1326 - DNA, 324 bp, Artificial Sequence
  Description of Artificial Sequence: Synthetic polynucleotide
gacatccggatgacccagtctccatcctccctgtctgcatctgtaggagaccgtgtcaccatcacttgccgggcaagtcggccgattagtggttgtttagattggtaccagcagaaaccagggaaagcccctaagctcctgatcgatggggcttccgggttgcaaagtggggtcccatcacgtttcagtggcagtggatctgggacagatttcactctcaccatcagcagtctgcaacctgaagattttgctacgtactactgtgggcagtggtgggagtatcctcctacgttcggccaagggaccaaggtggaaatcaaacgg

SEQ ID NO: 1327 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtaagcctattgtgagggatttagagtggtaccagcagaaaccagggaaagcccctaagctcctgatccatggtgtgtccacgttgcaaagtggggtcccatcacgtttcagtggcagtggatctgggacagatttcactctcaccatcagcagtctgcaacctgaagattttgctacgtactactgtgggcagcttgaggcggcgcctgcgacgttcggccaagggaccaaggtggaaatcaaacgg

SEQ ID NO: 1328 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcgggatattggtgattggttatattggtaccagcagaaaccagggaaagcccctaggctcctgatcgtttgggcgtccgtgttgcaaagtggggtcccatcacgtttcagtggcagtggatctgggacagatttcactctcaccatcagcagtctgcaacctgaagattttgctacgtactactgtgcgcagtgggggactcctcctacgacgttcggccaagggaccaaggtggaaatcaaacgg

SEQ ID NO: 1329 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtaatcgtattgagtatggtttagattggtaccagcagaaaccagggaaagcccctaagctcctgatctcggggtcttcccgtttgcaaagtggggtcccatcacgtttcagtagcagtggatctgggacagatttcactctcaccatcagcagtctgcaacctgaagattttgctacgtactactgtgggcagcttgaggcggcgcctgcgacgttcggccaagggaccaaggtggaaatcaaacgg

SEQ ID NO: 1330 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcggaatattgggcattttttagattggtaccagcagaaaccagggaaagcccctaagctcctgatcttgggggggtcctcgttgcaaagtggggtcccatcacgtttcagtggcagcgggtctgggacagatttcactctcaccatcagcagtctgcaacctgaagattttgctacgtactactgtgggcagttggtggagcctcctgcgacgttcggccaagggaccaaggtggaaatcaaacgg

SEQ ID NO: 1331 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagttcgagtatttatagtgatttatattggtaccagcagaaaccagggaaagcccctaagctcctgatcgatgggtggtccgggttgcaaagtggggtcccatcacgtttcagtggcagtggatctgggacagatttcactctcaccatcagcagtctgcaacctgaagattttgctacgtactactgtgggcagctgcatcgtgctcctgcgacgttcggccaagggaccaaggtggaaatcaaacgg

SEQ ID NO: 1332 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtaggtttattactgatcgtttagattggtaccagcagaaaccagggaaagcccctaagctcctgatcggtggtgtttccgggttgcaaagtggggtcccatcacgtttcagtggcagtggatctgggacagatttcactctcaccatcagcagtctgcaacctgaagattttgctacgtactactgtgggcagagttcggagttgccttggacgttcggccaagggaccaaggtggaaatcaaacgg

SEQ ID NO: 1333 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcgtaagattggtagtgagttatattggtaccagcagaaaccagggaaagcccctaagctcctgatcggtggtaggtcccggttgcaaagtggggtcccatcacgtttcagtggcagtggatctgggacagatttcactctcaccatcagcagtctgcaacctgaagattttgctacgtactactgtgggcagttgtgggagcctcctgcgacgttcggccaagggaccaaggtggaaatcaaacgg

SEQ ID NO: 1334 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtaggaatattggtaatggtttagattggtaccagcagaaaccagggaaagcccctaagctcctgatcggggaggggtcccgtttgcaaagtggggtcccatcacgtttcagtggcagtggatctgggacagatttcactctcaccatcagcagtctgcaacctgaagattttgctacgtactactgtgggcagctttggcatactcctcctacgttcggccaagggaccaaggtggaaatcaaacgg

SEQ ID NO: 1335 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcggaatatttatggttggttatcgtggtaccagcagaaaccagggaaagcccctaggctcctgatcggtgggtggtccggtttgcaaagtggggtcccatcacgtttcagtggcagtggatctgggacagatttcactctcaccatcagcagtctgcaacctgaagattttgctacgtactactgtgcgcaggattatacgttgcctggtacgttcggccaagggaccaaggtggaaatcaaacgg

SEQ ID NO: 1336 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcaggatattaaggattggttacattggtaccagcagaaaccagggaaagcccctaagctcctgatctattttgcgtccggtttgcaaagtggggtcccatcacgtttcagtggcagtggatctgggacagatttcactctcaccatcagcagtctgcaacctgaagattctgctacgtactactgtcaacagcattatagtacgccttatacgtccggccaagggaccaaggtggaaatcaaacgg

SEQ ID NO: 1337 - DNA, 324 bp, Artificial Sequence
  Description of Artificial Sequence: Synthetic polynucleotide
gacatccagatgacccagtctccaccctccctgtctgcatctgtaggagaccgtgtcaccatcacttgccgggcaagtcagttgatttcttctcatttagattggtaccagcagaaaccagggaaagcccctaagctcctggtctatgatgcttccgagttgcaaagtggggtcccatcacgtttcagtggcagtggatctgggacagatttcactctcaccatcagcagtctgcaacctgaagattttgctacgtactactgtcaacagcatcgcagtctgccttttacgttcggccaagggaccaaggtagaaatcaaacgg

SEQ ID NO: 1338 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcagtggattggtggggcgttagcgtggtaccagcagaaaccagggaaagcccctaggctccttatctatcagatttccgttttgcaaagtgggatcccatcacgtttcagtggcagtggatctgggacagatttcactctcaccatcagcagtctgcaacctgaagattttgctacgtactactgtcaacagtatattcggtctccttttacgttcggccaagggaccaaggtggaaatcaaacgg

SEQ ID NO: 1339 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcagagtattggggcggcgttaaattggtatcagcagaaaccagggaaagcccctaagctcctgatctatggtctgtcctctttgcaaagtggggtcccatcacgtttcagtggcagtggatctgggacagatttcactctcaccatcagcagtctgcaacctgaagattttgctacgtactactgtcaacagctgtttaggcttcctttgacgttcggccaagggaccaaggtggaaatcaaacgg

SEQ ID NO: 1340 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcagcctattgggggtcgtttagtgtggtaccagcagaaaccagggaaagcccctaagctcctgatctatgggtcttccattttgcaaagtggggtcccatcacgtttcagtggcagtggatctgggacagatttcactctcaccatcagcagtctgcaacctgaagattttgctacgtactactgtcaacagtatgctgaggctcctattacgttcggccaagggaccaaggtggaaatcaaacgg

SEQ ID NO: 1341 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcagaatattgggtctagtttaatttggtaccagcagaaaccagggaaagcccctacgctcctgatctattattcgtccaagttgcaaagtggggtcccatcacgtttcagtggcagtggatctgggacagatttcactctcaccatcagcagtctgcaacctgaagattttgctacgtactactgtcaacagtctttgtcgagtccttatacggtcggccaagggaccaaggtggaaatcaaacgg

SEQ ID NO: 1342 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcagtggattgggagtgagttagcgtggtatcagcagaaaccagggaaagcccctaagctcctgatctattggacgtccaatttgcaaagtggggtcccatcacgtttcagtggcagtggatctgggacagatttcactctcaccatcagcaatctgcaacctgaagattttgctacgtactactgtcaacagattctggagactcctttgacgtttggccaagggaccaaggtggaaatcaaacgg

SEQ ID NO: 1343 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcagaagatttgggatgctttatattggtatcagcagaaaccagggaaagcccctaagctcctgatctatcgtgggtccattttgcaaagtggggtcccatcacgtttcagtggcagtggatctgggacagatttcactctcaccatcagcagtctgcaacctgaagattttgctacgtactactgtcaacagttttatcggtggcctcatacgttcggccaagggaccaaggtggaaatcaaacgg

SEQ ID NO: 1344 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcagcatattgaggattctttacggtggtaccagcagaaaccagggaaagcccctaagctcctgatctattatggttccgtgttgcaaagtggggtcccatcacgtttcagtggcagtggatctgggacagatttcactctcaccatcagcagtctgcaacctgaagattttgctacgtactactgtcaacagatgtataagtttcctattacgttcggccaagggaccaaggtggaaatcaaacgg

SEQ ID NO: 1345 - DNA, 324 bp, Artificial Sequence
  Description of Artificial Sequence: Synthetic polynucleotide
gacatccagacgacccagtctccatcctccctgtctgcatctgtaggagaccgtgtcaccatcacttgccgggcaagtcagcggattaattcttctttactgtggtaccagcagaaaccagggaaagcccctaagctcctgatctatgatacttccactttgcaaagtggggtcccatcacgtttcagtggcagtagatctgggacagatttcactctcaccatcagcagtctgcaacctgaagatttcgctacgtactactgtcaacagatttggggttcgcctcctacgttcggccaggggaccaaggtggaaatcaaacgg

SEQ ID NO: 1346 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcagtcgattcctgttggtttaaattggtaccagcagaaaccagggaaagcccctaggctcctgatctattctgggtccactttgcaaagtggggtcccatcacgtttcagtggcagtggatctgggacagatttcactctcaccatcagcagtctgcaacctgaagattttgctacgtactactgtcaacaggattggtattatcctaatacgttcggccaagggaccaaggtggaaatcaaacgg

SEQ ID NO: 1347 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcagcctatttatggttggttaaattggtatcagcagaaaccagggaaagcccctaagctcctgatctatttgacgtccgggttgcaaagtggggtcccatcacgtttcagtggcagtggatctgggacagatttcactctcaccatcagcagtctgcaacctgaagattttgctacgtactactgtcaacagattcatagttctccttttacgttcggccaagggaccaaggtggaaatcaaacgg

SEQ ID NO: 1348 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcagtttattgatacgtcgttagagtggtatcagcagaaaccagggaaagcccctaagctcctgatctatgatgggtcccatttgcaaagtggggtcccatcacgtttcagtggcagtggatctgggacagatttcactctcaccatcagcagtctgcaacctgaagatttagctacgtactactgtcaacagtattgggttcttcctctgacgttcggccaagggaccaaggtggaaatcaaacgg

SEQ ID NO: 1349 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcaggatattggggatgctttattttggtaccagcagaaaccagggaaagcccctaagctcctgatctattattcttccatgttgcaaagtggggtcccatcacgtttcagtggcggtggatctgggacagatttcactctcaccatcagcagtctgcaacctgaagattttgctacgtactactgtcaacagcggcatagtactcctgctacgttcggccaagggaccaaggtggaaatcaaacgg

SEQ ID NO: 1350 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcaggatattgatgagtctttaatgtggtaccagcagaaaccagggaaagcccctaggctcctgatctatggggtgtcctatttgcaaagtggggtcccatcacgtttcagtggcagtggatctgggacagatttcactctcaccatcagcagtctgcaacctgaagatttcgctacgtactactgtcaacagcggtggaaggctccttttacgttcggccaagggaccaaggtggaaatcaaacgg

SEQ ID NO: 1351 - DNA, 324 bp, Artificial Sequence
  Description of Artificial Sequence: Synthetic polynucleotide
gacatccagatgacccagtctccatcctccctgtctgcatctgtaggagaccgtgttaccatcacttgccgggcaagtcaggagattgtggaggatttatattggtatcagcagaaaccagggaaagccgctaagctcctgatctatggtgcgtcctggttgcaaagtggggtcccatcacgtttcagtggcagtggatctgggacagatttcactctcaccatcagcagtctgcaacctgaagattttgctacgtactactgtcaacagacgcgtaggcgtccttatacgttcggccaagggaccaaggtggaaatcaaacgg

SEQ ID NO: 1352 - DNA, 324 bp, Artificial Sequence
  Description of Artificial Sequence: Synthetic polynucleotide
gacatccagatgacccagtctccagcctccctgtctgcatctgtaggagaccgtgtcaccatcacttgccgggcaagtcaggatattgatcctatgttaaggtggtaccagcagaaaccagggaaagcccctaagctcctgatctatgcgggttccattttgcaaagtggggtcccatcacgtttcagtggcagtggatctgggacagatttcactctcaccatcagcagtctgcaacctgaagattttgctacgtactactgtcaacagacgctggtgactccttatacgttcggccaagggaccaaggtggaaatcaaacgg

SEQ ID NO: 1353 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcagtcgatttcggatgcgttattttggtaccagcagaaaccagggaaagcccctaggctcctgatctattatggttccgttttgcaaagtggggtcccatcacgtttcagtggcagtggatctgggacagatttcactctcaccatcagcagtctgcaacctgaagattttgctacgtactactgtcaacagcgttttcaggagcctgtgacgttcggccaagggaccaaggtggaaatcaaacgg

SEQ ID NO: 1354 - DNA, 324 bp, Artificial Sequence
  Description of Artificial Sequence: Synthetic polynucleotide
gacatccagatgacccagtctccatcctccctgtccgcatctgtaggagaccgtgtcaccatcacttgccgggcaagtcagcagattagtgatgagttaaattggtatcagcagaaaccagggaaagcccctaagctcctgatctatgctgtgtccattttgcaaagtggggtcccatcacgtttcagtggcagtggatctgggacagatttcactctcaccatcagcagtctgcaacctgaagattttgctacgtactactgtcaacagtggttgagttttccttcgacgtttggccaagggaccaaggtggaaatcaaacgg

SEQ ID NO: 1355 - protein, 353 aa, Artificial Sequence
  Description of Artificial Sequence: Synthetic polypeptide
EVQLLESGGGLVQPGGSLRLSCAASGFTFNWELMGWARQAPGKGLEWVSGIEGPGDVTYYADSVKGRFTISRDNSKNTLYLQMNSLRAEDTAVYYCVKVGKDAKSDYRGQGTLVTVSSASTEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1356 - protein, 10 aa, Artificial Sequence
  Description of Artificial Sequence: Synthetic peptide
ASTHTCPPCP

SEQ ID NO: 1357 - protein, 18 aa, Artificial Sequence
  Description of Artificial Sequence: Synthetic peptide
ASTEPKSSDKTHTSPPSP

SEQ ID NO: 1358 - protein, 10 aa, Artificial Sequence
  Description of Artificial Sequence: Synthetic peptide
ASTHTSPPSP

SEQ ID NO: 1359 - protein, 18 aa, Artificial Sequence
  Description of Artificial Sequence: Synthetic peptide
ASTEPKSSDKTHTSPPSP

SEQ ID NO: 1360 - protein, 10 aa, Artificial Sequence
  Description of Artificial Sequence: Synthetic peptide
ASTHTSPPSP

SEQ ID NO: 1361 - protein, 24 aa, Artificial Sequence
  Description of Artificial Sequence: Synthetic peptide
MRAWIFFLLCLAGRALAEVQLLES

SEQ ID NO: 1362 - protein, 370 aa, Artificial Sequence
  Description of Artificial Sequence: Synthetic polypeptide
MRAWIFFLLCLAGRALAEVQLLESGGGLVQPGGSLRLSCAASGFTFNWELMGWARQAPGKGLEWVSGIEGPGDVTYYADSVKGRFTISRDNSKNTLYLQMNSLRAEDTAVYYCVKVGKDAKSDYRGQGTLVTVSSASTEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1363 - protein, 362 aa, Artificial Sequence
  Description of Artificial Sequence: Synthetic polypeptide
MRAWIFFLLCLAGRALAEVQLLESGGGLVQPGGSLRLSCAASGFTFNWELMGWARQAPGKGLEWVSGIEGPGDVTYYADSVKGRFTISRDNSKNTLYLQMNSLRAEDTAVYYCVKVGKDAKSDYRGQGTLVTVSSASTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1364 - protein, 370 aa, Artificial Sequence
  Description of Artificial Sequence: Synthetic polypeptide
MRAWIFFLLCLAGRALAEVQLLESGGGLVQPGGSLRLSCAASGFTFNWELMGWARQAPGKGLEWVSGIEGPGDVTYYADSVKGRFTISRDNSKNTLYLQMNSLRAEDTAVYYCVKVGKDAKSDYRGQGTLVTVSSASTEPKSSDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1365 - protein, 362 aa, Artificial Sequence
  Description of Artificial Sequence: Synthetic polypeptide
MRAWIFFLLCLAGRALAEVQLLESGGGLVQPGGSLRLSCAASGFTFNWELMGWARQAPGKGLEWVSGIEGPGDVTYYADSVKGRFTISRDNSKNTLYLQMNSLRAEDTAVYYCVKVGKDAKSDYRGQGTLVTVSSASTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

What is claimed is:

1. An isolated antibody polypeptide comprising a first variable domain that specifically binds human CD40L, wherein CD40L comprises the amino acid sequence of SEQ ID NO: 1, wherein the amino acid sequence of the first variable domain comprises
   (a) a CDR1 region of BMS2h-572-633 comprising SEQ ID NO: 2,
   (b) a CDR2 region of BMS2h-572-633 comprising SEQ ID NO: 3,
   (c) a CDR3 region of BMS2h-572-633 comprising SEQ ID NO: 4,
   (d) a FR1 region of BMS2h-572-633 comprising SEQ ID NO: 5,
   (e) a FR2 region of BMS2h-572-633 comprising SEQ ID NO: 6,
   (f) a FR3 region of BMS2h-572-633 comprising SEQ ID NO: 7, and
   (g) a FR4 region of BMS2h-572-633 comprising SEQ ID NO: 8; and
   wherein the antibody polypeptide inhibits binding of CD40L to CD40 with an EC50 of 100 pM to 100 nM.

2. The antibody polypeptide of claim 1, wherein the antibody polypeptide is selected from the lineage group of BMS2h-572, and wherein the amino acid sequence of the first variable domain further comprises:
   (a) a CDR1 region having a sequence Trp-$X_1$-Leu-Met-Gly (SEQ ID NO: 2), wherein $X_1$ is Glu;
   (b) a CDR2 region having a sequence Gly-Ile-Glu-Gly-Pro-Gly-Asp-Val-Thr-Tyr-Tyr-Ala-Asp-Ser-Val-Lys-Gly (SEQ ID NO: 3); and
   (c) a CDR3 region having a sequence Lys-$X_2$-$Y_2$-$Z_2$-Ser-Asp-Tyr (SEQ ID NO: 4), wherein $X_2$ is Asp, $Y_2$ is Ala, and $Z_2$ is Lys.

3. The antibody polypeptide of claim 2, wherein the amino acid sequence of the first variable domain further comprises:
   (a) a FR1 region having a sequence Glu-Val-Gln-Leu-Leu-Glu-Ser-Gly-Gly-Gly-Leu-Val-Gln-Pro-Gly-Gly-Ser-Leu-Arg-Leu-Ser-Cys-Ala-Ala-Ser-Gly-Phe-Thr-Phe-Asn (SEQ ID NO: 5);
   (b) a FR2 region having a sequence Trp-$X_1$-Arg-Gln-Ala-Pro-Gly-Lys-Gly-Leu-Glu-Trp-Val-Ser (SEQ ID NO: 6), wherein $X_1$ is Ala;
   (c) a FR3 region having a sequence Arg-Thr-Phe-Ile-Ser-Arg-Asp-Asn-Ser-Lys-Asn-Thr-Leu-Tyr-Leu-Gln-Met-Asn-Ser-Leu-Arg-Ala-Glu-Asp-Thr-Ala-Val-Tyr-Tyr-Cys-Val-Lys-Val-Gly (SEQ ID NO: 7); and
   (d) a FR4 region having a sequence Arg-Gly-Gln-Gly-Thr-Leu-Val-Thr-Val-Ser-Ser (SEQ ID NO: 8).

4. An antibody polypeptide comprising the amino acid sequence of BMS2h-572-633 (SEQ ID NO: 274).

5. The antibody polypeptide of claim 1, wherein the antibody polypeptide is a domain antibody (dAb).

6. The antibody polypeptide of claim 4, wherein the antibody polypeptide is a fusion polypeptide comprising the first variable domain and an Fc domain.

7. The fusion polypeptide of claim 6, wherein the fusion polypeptide comprises an IgG4 Fc domain.

8. The fusion polypeptide of claim 6, wherein the fusion polypeptide comprises an IgG1 Fc domain.

9. The fusion polypeptide of claim 6, wherein the fusion polypeptide comprises a CT-Long domain.

10. The fusion polypeptide of claim 6, wherein the fusion polypeptide comprises a CT-short domain.

11. The fusion polypeptide of claim 6, wherein the fusion polypeptide comprises a N297Q Long Fc domain.

12. The fusion polypeptide of claim 6, wherein the fusion polypeptide comprises a N297Q Short Fc domain.

13. The antibody polypeptide of claim 1, wherein the antibody polypeptide further comprises a second variable domain that specifically binds a second antigen, wherein the second antigen is an antigen other than human CD40L.

14. The antibody polypeptide of claim 13, wherein the second antigen is a cluster of differentiation (CD) molecule or a Major Histocompatibility Complex (MHC) Class II molecule.

15. The antibody polypeptide of claim 13, wherein the second antigen is serum albumin (SA).

16. A pharmaceutical composition comprising a therapeutically-effective amount of the antibody polypeptide of claim 1 and a pharmaceutically acceptable carrier.

17. The pharmaceutical composition of claim 16, further comprising an immunosuppressive/immunomodulatory and/or anti-inflammatory agent.

18. A method of antagonizing CD40L activity in a patient with an immune disease in need of such treatment, comprising administering to the patient a therapeutically effective amount of the pharmaceutical composition of claim 16 to antagonize CD40L activity in the patient.

19. The method of claim 18, wherein the isolated antibody polypeptide is administered in combination with an immunosuppressive/immunomodulatory and/or inflammatory agent.

20. The method of claim 18, wherein the immune disease is an autoimmune disease or a graft-related disease.

21. The method of claim 18, wherein the immune disease is a graft-related disease.

22. The method of claim 21, wherein the graft-related disease comprises solid organ, tissue and/or cell transplant rejection.

23. The method of claim 21, wherein the graft-related disease is graft versus host disease (GVHD).

24. The method of claim 21, wherein the graft-related disease is an acute transplant rejection.

25. The method of claim 21, wherein the graft-related disease is a chronic transplant rejection.

26. The method of claim 21, wherein the isolated antibody polypeptide is co-administered with a CTLA4 mutant molecule.

27. The method of claim 26, wherein the CTLA4 mutant molecule is L104EA29Y-Ig (belatacept).

28. The method of claim 18, wherein the immune disease is selected from the group consisting of Addison's disease, allergies, ankylosing spondylitis, asthma, atherosclerosis, autoimmune diseases of the ear, autoimmune diseases of the eye, autoimmune hepatitis, autoimmune parotitis, colitis, coronary heart disease, Crohn's disease, diabetes, including Type 1 and/or Type 2 diabetes, epididymitis, glomerulonephritis, Graves' disease, Guillain-Barre syndrome, Hashimoto's disease, hemolytic anemia, idiopathic thrombocytopenic purpura, inflammatory bowel disease, immune response to recombinant drug products, systemic lupus erythematosus, male infertility, multiple sclerosis, myasthenia gravis, pemphigus, psoriasis, rheumatic fever, rheumatoid arthritis, sarcoidosis, scleroderma, Sjogren's syndrome, spondyloarthropathies, thyroiditis, transplant rejection, vasculitis, AIDS, atopic allergy, bronchial asthma, eczema, leprosy, schizophrenia, inherited depression, chronic fatigue syndrome, Alzheimer's disease, Parkinson's disease, myocardial infarction, stroke, autism, epilepsy, Arthus's phenomenon, anaphylaxis, alcohol addiction, and drug addiction.

29. The method of claim 18, wherein the immune disease is selected from the group consisting of myasthenia gravis, idiopathic thrombocytopenic purpura, and systemic sclerosis.

30. An isolated antibody polypeptide comprising a first variable domain of BMS2h-572 (SEQ ID NO: 223).

31. An isolated antibody polypeptide comprising a first variable domain selected from the group consisting of the amino acid sequence of BMS2h-572-6 (SEQ ID NO: 243), BMS2h-572-608 (SEQ ID NO: 251), BMS2h-572-614 (SEQ ID NO: 257), BMS2h-572-619 (SEQ ID NO: 262), BMS2h-572-633 (SEQ ID NO: 274), BMS2h-572-634 (SEQ ID NO: 275), or BMS2h-572-635 (SEQ ID NO: 276).

32. A fusion polypeptide comprising SEQ ID NO: 1355.

33. A pharmaceutical composition comprising a therapeutically-effective amount of the antibody polypeptide of claim 4 and a pharmaceutically acceptable carrier.

34. A pharmaceutical composition comprising a therapeutically-effective amount of the antibody polypeptide of claim 6 and a pharmaceutically acceptable carrier.

35. A pharmaceutical composition comprising a therapeutically-effective amount of the antibody polypeptide of claim 31 and a pharmaceutically acceptable carrier.

36. A pharmaceutical composition comprising a therapeutically-effective amount of the fusion polypeptide of claim 32 and a pharmaceutically acceptable carrier.

* * * * *